(12) United States Patent
Lonberg et al.

(10) Patent No.: US 9,605,080 B2
(45) Date of Patent: Mar. 28, 2017

(54) ANTIBODIES AGAINST CD73

(71) Applicant: BRISTOL-MYERS SQUIBB COMPANY, Princeton, NJ (US)

(72) Inventors: Nils Lonberg, Woodside, CA (US); Alan J. Korman, Piedmont, CA (US); Bryan C. Barnhart, San Francisco, CA (US); Aaron P. Yamniuk, Lawrenceville, NJ (US); Mohan Srinivasan, Cupertino, CA (US); Karla A. Henning, Milpitas, CA (US); Ming Lei, Princeton, NJ (US); Emanuela Sega, Cupertino, CA (US); Angela Goodenough, Morrisville, PA (US); Maria N. Jure-Kunkel, Plainsboro, NJ (US); Guodong Chen, East Brunswick, NJ (US); John S. Sack, Lawrenceville, NJ (US); Richard Huang, Plainsboro, NJ (US); Martin J. Corbett, Princeton, NJ (US); Joseph E. Myers, Jr., Flemington, NJ (US); Liang Schweizer, Shanghai (CN); Sandra V. Hatcher, Hillsborough, NJ (US); Haichun Huang, Fremont, CA (US); Pingping Zhang, Cupertino, CA (US)

(73) Assignee: BRISTOL-MYERS SQUIBB COMPANY, Princeton, NJ (US)

( * ) Notice: Subject to any disclaimer, the term of this patent is extended or adjusted under 35 U.S.C. 154(b) by 0 days.

(21) Appl. No.: 14/994,828

(22) Filed: Jan. 13, 2016

(65) Prior Publication Data
US 2016/0145350 A1 May 26, 2016

Related U.S. Application Data

(63) Continuation of application No. PCT/US2015/061639, filed on Nov. 19, 2015.
(Continued)

(51) Int. Cl.
| C07K 16/30 | (2006.01) |
| C07K 16/40 | (2006.01) |
| A61K 39/00 | (2006.01) |
| A61K 39/395 | (2006.01) |
| A61K 45/06 | (2006.01) |
| G01N 33/573 | (2006.01) |

(52) U.S. Cl.
CPC .......... *C07K 16/40* (2013.01); *A61K 39/3955* (2013.01); *A61K 45/06* (2013.01); *C07K 16/30* (2013.01); *C07K 16/303* (2013.01); *C07K 16/3015* (2013.01); *C07K 16/3023* (2013.01); *C07K 16/3038* (2013.01); *C07K 16/3046* (2013.01); *C07K 16/3053* (2013.01); *C07K 16/3061* (2013.01); *C07K 16/3069* (2013.01); *G01N 33/573* (2013.01); *A61K 2039/505* (2013.01); *C07K 2317/21* (2013.01); *C07K 2317/31* (2013.01); *C07K 2317/34* (2013.01); *C07K 2317/522* (2013.01); *C07K 2317/524* (2013.01); *C07K 2317/526* (2013.01); *C07K 2317/53* (2013.01); *C07K 2317/565* (2013.01); *C07K 2317/76* (2013.01); *C07K 2317/77* (2013.01); *C07K 2317/92* (2013.01); *G01N 2333/916* (2013.01)

(58) Field of Classification Search
CPC .. A61K 39/3955; A61K 45/06; G01N 33/573; C07K 16/30; C07K 16/3015; C07K 16/3023; C07K 16/303; C07K 16/3038; C07K 16/3046; C07K 16/3053; C07K 16/3061; C07K 16/3039; C07K 16/40
See application file for complete search history.

(56) References Cited

U.S. PATENT DOCUMENTS

| 5,624,821 A | 4/1997 | Winter et al. |
| 5,677,425 A | 10/1997 | Bodmer et al. |

(Continued)

FOREIGN PATENT DOCUMENTS

| CN | 103278634 A | 9/2013 |
| EP | 0347433 A1 | 12/1989 |

(Continued)

OTHER PUBLICATIONS

Armour, K.L. et al. Recombinant human IgG molecules lacking Fc gamma receptor I binding and monocyte triggering activities. Eur. J. Immunol., vol. 29, p. 2613-2624 (1999).*
Terp, M.G. et al. Anti-human CD73 monoclonal antibody inhibits metastasis formation in human breast cancer by inducing clustering and internalization of CD73 expressed on the surface of cancer cells. J. Immunol., vol. 191(8):4165-4173 (2013).*
Barnhart, B. et al., "A Therapeutic Antibody that Inhibits CD73 Activity by Dual Mechanisms," Bristol-Myers Squibb, AACR Annual Meeting 2016, Apr. 16-20, 2016, New Orleans, Louisiana, USA, Abstract No. 1476, 1 page.
Barnhart, B., "Antibody Inhibition of CD73 Activity by Multiple Mechanisms for Tumor Therapy," Bristol-Myers Squibb, Apr. 14, 2016, Presentation Slides, 19 pages.
Geoghegan, JC et al., "Inhibition of CD73 AMP hydrolysis by a therapeutic antibody with a dual, non-competitive mechanism of action," MAbs, vol. 8 (3): 454-467 (2016) doi: 10.1080/19420862.2016.1143182. Epub Feb. 8, 2016.
(Continued)

*Primary Examiner* — Robert Landsman
*Assistant Examiner* — Bruce D Hissong
(74) *Attorney, Agent, or Firm* — Nelson Mullins Riley & Scarborough LLP; Jane E. Remillard, Esq.; Jeanne M. DiGiorgio, Esq.

(57) ABSTRACT

The present invention provides isolated monoclonal antibodies, particularly human antibodies, that bind to human Cluster of Differentiation 73 (CD73) with high affinity, and inhibit the activity of CD73, and optionally mediate antibody dependent CD73 internalization. Nucleic acid molecules encoding the antibodies of the invention, expression vectors, host cells and methods for expressing the antibodies of the invention are also provided. Immunoconjugates, bispecific molecules and pharmaceutical compositions comprising the antibodies of the invention are also provided. The invention also provides methods for inhibiting the growth of a tumor cell expressing CD73 using the antibodies of the invention, including methods for treating various cancers.

30 Claims, 87 Drawing Sheets

Related U.S. Application Data

(60) Provisional application No. 62/083,056, filed on Nov. 21, 2014.

(56) References Cited

U.S. PATENT DOCUMENTS

| | | |
|---|---|---|
| 6,737,056 B1 | 5/2004 | Presta |
| 6,861,225 B1 | 3/2005 | Bertha et al. |
| 6,896,885 B2 | 5/2005 | Hanna |
| 7,148,321 B2 | 12/2006 | Gillies et al. |
| 7,247,302 B1 | 7/2007 | Rosok et al. |
| 7,597,889 B1 | 10/2009 | Armour et al. |
| 7,741,072 B2 | 6/2010 | Idusogie et al. |
| 7,927,594 B2 | 4/2011 | Rosenthal et al. |
| 8,066,994 B2 | 11/2011 | Gillies et al. |
| 8,101,720 B2 | 1/2012 | Lazar et al. |
| 8,399,618 B2 | 3/2013 | Lazar et al. |
| 8,562,986 B2 | 10/2013 | Goodman et al. |
| 8,728,469 B2 | 5/2014 | Thompson et al. |
| 8,735,553 B1 | 5/2014 | Li et al. |
| 8,883,147 B2 | 11/2014 | Lazar et al. |
| 2003/0109690 A1 | 6/2003 | Ruben et al. |
| 2004/0031072 A1 | 2/2004 | La Rosa et al. |
| 2004/0146516 A1 | 7/2004 | Roben et al. |
| 2006/0134105 A1 | 6/2006 | Lazar et al. |
| 2007/0042392 A1 | 2/2007 | Tang et al. |
| 2007/0184444 A1 | 8/2007 | Abbas et al. |
| 2009/0203538 A1 | 8/2009 | Sugioka et al. |
| 2010/0209942 A1 | 8/2010 | Jalkanen et al. |
| 2010/0226925 A1 | 9/2010 | Dillon et al. |
| 2010/0298542 A1 | 11/2010 | Igawa et al. |
| 2011/0059078 A1 | 3/2011 | Coyle et al. |
| 2011/0212087 A1 | 9/2011 | Strohl et al. |
| 2011/0229459 A1 | 9/2011 | Kuramochi et al. |
| 2011/0245090 A1 | 10/2011 | Abbas et al. |
| 2011/0245473 A1 | 10/2011 | Igawa et al. |
| 2012/0065379 A1 | 3/2012 | Igawa et al. |
| 2012/0071634 A1 | 3/2012 | Igawa et al. |
| 2012/0128677 A1 | 5/2012 | Domon et al. |
| 2012/0238729 A1 | 9/2012 | Kuramochi et al. |
| 2013/0052160 A1 | 2/2013 | Zitvogel et al. |
| 2013/0101581 A1 | 4/2013 | Kuramochi et al. |
| 2013/0144041 A1 | 6/2013 | Dillon et al. |
| 2013/0156790 A1 | 6/2013 | Zitvogel et al. |
| 2013/0217033 A1 | 8/2013 | Jalkanen et al. |
| 2013/0317201 A1 | 11/2013 | Ishii et al. |
| 2013/0317203 A1 | 11/2013 | Igawa et al. |
| 2014/0235833 A1 | 8/2014 | Sugioka et al. |
| 2014/0371427 A1 | 12/2014 | Dillon et al. |
| 2015/0030534 A1 | 1/2015 | Howell et al. |
| 2015/0071948 A1 | 3/2015 | Lazar et al. |
| 2016/0129108 A1 | 5/2016 | Sachsenmeier et al. |

FOREIGN PATENT DOCUMENTS

| | | |
|---|---|---|
| EP | 1068241 A1 | 1/2001 |
| EP | 1075496 A1 | 2/2001 |
| EP | 1283722 A1 | 2/2003 |
| EP | 1366067 A2 | 12/2003 |
| EP | 1746107 A2 | 1/2007 |
| EP | 2014675 A1 | 1/2009 |
| EP | 2078732 A1 | 7/2009 |
| EP | 2182006 A2 | 5/2010 |
| EP | 2194066 A1 | 6/2010 |
| EP | 2197911 A2 | 6/2010 |
| EP | 2201376 A1 | 6/2010 |
| EP | 2409991 A1 | 1/2012 |
| EP | 2481752 A1 | 8/2012 |
| EP | 2503338 A2 | 9/2012 |
| EP | 2506871 A1 | 10/2012 |
| EP | 2561088 A1 | 2/2013 |
| EP | 2788097 A2 | 10/2014 |
| WO | 8901974 A1 | 3/1989 |
| WO | 99/51642 A1 | 10/1999 |
| WO | 99/58572 A1 | 11/1999 |
| WO | 00/42072 A2 | 7/2000 |
| WO | 0067796 A1 | 11/2000 |
| WO | 01/46232 A2 | 6/2001 |
| WO | 01/46261 A1 | 6/2001 |
| WO | 01/74388 A1 | 10/2001 |
| WO | 0190403 A1 | 11/2001 |
| WO | 02/04613 A2 | 1/2002 |
| WO | 02072605 A2 | 9/2002 |
| WO | 2004/079013 A1 | 9/2004 |
| WO | 2005/016962 A2 | 2/2005 |
| WO | 2005/019258 A2 | 3/2005 |
| WO | 2005073732 A2 | 8/2005 |
| WO | 2006/047350 A2 | 5/2006 |
| WO | 2006047340 A2 | 5/2006 |
| WO | 2006075668 A1 | 7/2006 |
| WO | 2007148417 A1 | 12/2007 |
| WO | 2008/007648 A1 | 1/2008 |
| WO | 2008/070593 A2 | 6/2008 |
| WO | 2009010290 A2 | 1/2009 |
| WO | 2009036209 A2 | 3/2009 |
| WO | 2009041613 A1 | 4/2009 |
| WO | 2009053368 A1 | 4/2009 |
| WO | 2009053523 A1 | 4/2009 |
| WO | 2010107110 A1 | 9/2010 |
| WO | 2011037158 A1 | 3/2011 |
| WO | 2011052799 A1 | 5/2011 |
| WO | 2011066501 A1 | 6/2011 |
| WO | 2011/120134 A1 | 10/2011 |
| WO | 2011131246 A1 | 10/2011 |
| WO | 2011131472 A1 | 10/2011 |
| WO | 2012007783 A1 | 1/2012 |
| WO | 2012012736 A2 | 1/2012 |
| WO | 2012031320 A1 | 3/2012 |
| WO | 2013086448 A2 | 6/2013 |
| WO | 2013/112986 A1 | 8/2013 |
| WO | 2014003553 A1 | 1/2014 |
| WO | 2014153424 A1 | 9/2014 |
| WO | 2015/145360 A1 | 10/2015 |
| WO | 2015/164573 A1 | 10/2015 |
| WO | 2016055609 A1 | 4/2016 |
| WO | 2016075099 A1 | 5/2016 |
| WO | 2016075176 A1 | 5/2016 |

OTHER PUBLICATIONS

International Search Report and Written Opinion, PCT/US2015/061639, dated Jul. 18, 2016, 31 pages.

Rust, S. et al., "Combining phenotypic and proteomic approaches to identify membrane targets in a 'triple negative' breast cancer cell type," Molecular Cancer, vol. 12(11), pp. 1-11 (2013).

Beavis, P. et al., "A2A blockade enhances anti-metastatic immune responses," OncoImmunology, vol. 2(12), e26705-1-e26705-3 (2013).

Buisseret, L. et al., "CD73 Expression on Tumor-infiltrating Breast Cancer Leukocytes," Proceedings of the 106th Annual Meeting of the American Association for Cancer Research? Apr. 18-22, 2015?Philadelphia, PA. Philadelphia (PA): AARC 2015, Poster Presentation, Abstract No. 3361, 1 page.

Chappel, S. et al., "Identification of the Fcγ receptor class I binding site in human IgG through the use of recombinant IgG1/IgG2 hybrid and point-mutated antibodies," PNAS, vol. 88, pp. 9036-9040 (1991).

Hay, C. et al., MEDI9447: enhancing anti-tumor immunity by targeting CD73 in the tumor microenvironment, Proceedings of the 106th Annual Meeting of the American Association for Cancer Research? Apr. 18-22, 2015? Philadelphia, PA. Philadelphia(PA): AARC 2015, Abstract No. 285, 2 pages.

Huang, Q. et al., "Levels and enzyme activity of CD73 in primary samples from cancer patients," Proceedings of the 106th Annual Meeting of the American Association for Cancer Research? Apr. 18-22, 2015?Philadelphia, PA. Philadelphia(PA): AARC 2015, Abstract No. 1538, 2 pages.

Huang, Q. et al., "Levels and enzyme activity of CD73 in primary samples from cancer patients," Proceedings of the 106th Annual Meeting of the American Association for Cancer Research? Apr. 18-22, 2015?Philadelphia, PA. Philadelphia(PA): AARC 2015,Poster Presentation, Abstract No. 1538, 2 pages.

(56) References Cited

OTHER PUBLICATIONS

Kai, M. et al., "Switching Constant Domains Enhances Agonist Activities of Antibodies to a Thrombopoietin Receptor," Nature Biotechnology, vol. 26(2), pp. 209-211 (2008).
Sachsenmeier, K. et al., "Development of a Novel Ectonucleotidase Assay Suitable for High-Throughput Screening," Journal of Biomolecular Screening, vol. 17(7), pp. 993-998 (2012).
Strater, N. et al., "Ecto-5'-nucleotidase: Structure function Relationships," Purinergic Signalling, vol. 2, pp. 343-350 (2006).
Sult, E. et al., "Checkpoint inhibitor combinations in a human mixed leukocyte reaction," Proceedings of the 106th Annual Meeting of the American Association for Cancer Research? Apr. 18-22, 2015?Philadelphia, PA. Philadelphia (PA): AARC 2015, Abstract No. 272, 2 pages.
Young, A. et al., "Targeting Cancer-Derived Adenosine: New Therapeutic Approaches," Cancer Discovery, vol. 4, pp. 879-888 (2014).
Allard, B. et al., "Targeting CD73 and downstream adenosine receptor signaling in triple-negative breast cancer," Expert Opinion Ther Targets, vol. 18 (Issue 7), pp. 1-19 (2014).
Allard, B. et al., "Targeting CD73 enhances the antitumor activity of anti-PD-1 and anti-CTLA-4 mAbs," Clin Cancer Res, pp. 5626-5635 (Oct. 15, 2013 ).
Allen, M. et al., "Interchain disulfide bonding in human IgG2 antibodies probed by site-directed mutagenesis," Biochemistry, vol. 48 (17), pp. 3755-3766 (Mar. 2009).
Beavis et al. "CD73: a potent suppressor of antitumor immune responses," Trends in Immunol., vol. 33(5), pp. 231-237 (2012).
Brekke, O. et al., "Human IgG isotype-specific amino acid residues affecting complement-mediated cell lysis and phagocytosis," Eur. J. Immunol, vol. 24, pp. 2542-2547 (1994).
Canfield, S. et al., "The binding affinity of human IgG for its high affinity Fc receptor is determined by multiple amino acids in the CH2 domain and is modulated by the hinge region.," J. Exp. Med., vol. 173, pp. 1483-1491 (1991).
Dillon, T.et al, "Development of an analytical reversed-phase high-performance liquid chromatography-electrospray ionization mass spectrometry method for characterization of recombinant antibodies," J. Chromatogr. A, vol. 1053, pp. 299-305 (2004).
Fukunaga, Y. et al., "Increased density of ecto 5' nucleotidase antigen on leukemic T cells from patients with cutaneous T-cell lymphoma and adult T-cell leukemia/lymphoma," Blood, vol. 74(7), pp. 2486-2492 (1989).
Greenwood, J. et al., "Structural motifs involved in human IgG antibody effector functions," Eur J Immol, vol. 23 (5), pp. 1098-1104 (1993).
Gross, J. et al., "TACI-Ig neutralizes molecules critical for B cell development and autoimmune disease. impaired B cell maturation in mice lacking BLyS.," Immunity, vol. 15, pp. 289-302 (2001).
Gutensohn, W. et al., "Production and properties of monoclonal Abs against human ecto-5'-nucloeotidase," Advances in Exp. Med. & Biol., vol. 195, pp. 385-389 (1986).
Hausler, SF., et al., "Anti-CD39 and anti-CD73 antibodies A1 and 7G2 improve targeted therapy in ovarian cancer by blocking adenosine-dependent immune evasion," Am J Transl Res., vol. 6(2), pp. 129-139 (2014).
Jin, D. et al., "CD73 on tumor cells impairs antitumor T-cell responses: a novel mechanism of tumor-induced immune suppression," Cancer Res., vol. 70(6), 2245-2255 (2 page Supplement data) (2010).
Klemens, M. et al., "Characterization of soluble vs membrane-bound human placental 5'-nucleotidase," Biochem Biophys Res Commun.,vol. 172(3), pp. 1371-1377 (1990).
Kummer, U. et al. "Development and properties of a monoclonal Ab specific for human Ecto-5'-nucleotidase," Immunobiology, vol. 166, pp. 203-211 (1984).
Lightl, S. et al., "Mutations within a human IgG2 antibody form distinct and homogeneous disulfide isomers but do not affect Fc gamma receptor or C1q binding," Protein Sci, vol. 19(4), pp. 753-762 (2010).
Martinez, T. et al., "Disulfide connectivity of human immunoglobulin G2 structural isoforms," Biochemistry, vol. 47(26), pp. 7496-7508 (May 2008).

Misumi, Y., et al., "Primary structure of human placental 5'-nucleotidase and identification of the glycolipid anchor in the mature form," (Fukuoka Univ., Jp), Eur J Biochem., vol. 191(3), pp. 563-569. (1990).
Mittal, D. et al., "Antimetastatic effects of blocking PD-1 and the adenosine A2A receptor," vol. 74(14) Cancer Res, pp. 3652-3658 (Jul. 2014).
Morgan, A. et al., "The N-terminal end of the CH2 domain of chimeric human IgG1 anti-FILA-DR is necessary for C1q, Fc gamma RI and Fc gamma RIII binding," Immunology, vol. 86 (2), pp. 319-324 (1995).
Morrison, S. et al., "Structural Determinants of Human IgG Function," Immunologist,vol. 2, pp. 119-124 (1994).
NCBI Reference Sequence NP_001191742.1, 4 pages (2012).
Nielsen, UB et al., "Internalizing antibodies and targeted cancer therapy: direct selection from phage display libraries," PSTT, vol. 3(8), pp. 282-291 (2000).
Resta, R. et al., "Murine ecto-5'-nucleotidase (CD73): cDNA cloning and tissue distribution," Gene, vol. 133(2), pp. 171-177 (1993) Abstract.
Resta, R. et al., "T cell signalling through CD73," Cell Signal, vol. 9(2), pp. 131-139 (1997).
Shields, RL., "High resolution mapping of the binding site on human IgG1 for Fc gamma RI, Fc gamma RII, Fc gamma RIII, and FcRn and design of IgG1 variants with improved binding to the Fc gamma R," J Biol Chem, vol. 276 (9), pp. 6591-6604 (2001).
Spychala J., "Tumor-promoting functions of adenosine," Pharmacology and Therapeutics, vol. 87 (2-3) pp. 161-173 (2000).
Stagg, J. et al., "Anti-CD73 Antibody therapy inhibits breast tumor growth and metastasis," PNAS, vol. 107(4), pp. 1547-1552 (2010).
Stagg, J. et al., "Extracellular adenosine triphosphate and adenosine in cancer," Oncogene , vol. 29 (39), pp. 5346-5358 (2010).
Tao, MH et al., "Structural features of human immunoglobulin G that determine isotype-specific differences in complement activation," J Exp Med, vol. 178(2), pp. 661-667 (1993).
Tao, MH., "The differential ability of human IgG1 and IgG4 to activate complement is determined by the COOH-terminal sequence of the CH2 domain," J Exp Med., vol. 173(4), pp. 1025-1028 (1991).
Terp, M. et al., "Anti-human CD73 monoclonal antibody inhibits metastasis formation in human breast cancer by inducing clustering and internalization of CD73 expressed on the surface of cancer cells," J. Immunol., vol. 191(8), pp. 4165-4173 (2013).
Thomson, L. et al., "Purification of 5'-nucleotidase from human placenta after release from plasma membranes by phosphatidylinositol-specific phospholipase C," Biochem Biophys Res Commun, vol. 145(1), pp. 118-125 (1987).
Thomson, L.F. et al., "Production and characterization of monoclonal antibodies to the glycosyl phosphatidylinositol-anchored lymphocyte differentiation antigen ecto-5'-nucleotidase (CD73)," Tissue Antigens, vol. 35(1), pp. 9-19 (1990).
White, A. et al., "Conformation of the human immunoglobulin G2 hinge imparts superagonistic properties to immunostimulatory anti-cancer antibodies," Cancer Cell., vol. 27(1), pp. 138-148 (2015).
Whiteside et al., "Disarming suppressor cells to improve immunotherapy," Immunol. Immunother, vol. 61, pp. 283-288 (2012).
Xu, Y. et al., "Residue at position 331 in the IgG1 and IgG4 CH2 domains contributes to their differential ability to bind and activate complement," Journal of Biological Chemistry, vol. 269(5, pp. 3469-3474 (1994).
Xu, Y. et al., The N-Terminal Sequence of the CH2 Domain Controls the Differential Ability of Human IgG 1 and IgG2 to Activate Complement, J. of Immunol., vol. 150, Abstract 862, p. 152A (1993).
Zhang , B., "CD73: A novel target for cancer immunotherapy," Cancer Res., vol. 70(16), pp. 6407-6411 (2010).
Zhang, B., "Opportunities and challenges for anti-CD73 cancer therapy," Immunotherapy, vol. 4(9), pp. 861-865 (2012).
Zhi, X. et al., "RNA interference of ecto-5'-nucleotidase (CD73) inhibits human breast cancer cell growth and invasion," Clin. Exp. Metastasis, vol. 24, pp. 439-448 (2007).

\* cited by examiner

Anti-CD73 CD73.4-1 VH

V segment:  VH3 / 3-33
D segment:  D6 / 6-13
J segment:  JH3 / 3

```
      Q   V   Q   L   V   E   S   G   G   G   V   V   Q   P   G   R   S
  1   CAG GTG CAG CTG GTG GAG TCT GGG GGA GGC GTG GTC CAG CCT GGG AGG TCC
                                                              CDR1
      L   R   L   S   C   A   A   S   G   F   T   F   S   S   N   Y   G   M
 52   CTG AGA CTC TCC TGT GCA GCA TCT GGA TTC ACC TTC AGT AAC TAT GGC ATG
                                                                    CDR2
      H   W   V   R   Q   A   P   G   K   G   L   E   W   V   A   V   I
103   CAC TGG GTC CGC CAG GCT CCA GGC AAG GGG CTG GAG TGG GTG GCA GTT ATA

L   Y   D   G   S   N   K   Y   Y   P   D   S   V   K   G   R   F
154   TTG TAT GAT GGA AGT AAT AAA TAC TAT CCA GAC TCC GTG AAG GGC CGA TTC

T   I   S   R   D   N   S   K   N   T   L   Y   L   Q   M   N   S
205   ACC ATC TCC AGA GAC AAT TCC AAG AAC ACG CTG TAT CTG CAA ATG AAC AGC
                                                              CDR3
      L   R   A   E   D   T   A   V   Y   Y   C   A   R   G   G   S   S
256   CTG AGA GCC GAG GAC ACG GCT GTG TAT TAC TGT GCG AGA GGG GGC AGC AGC

W   Y   P   D   S   F   D   I   W   G   Q   G   T   M   V   T   V
307   TGG TAC CCT GAT TCT TTT GAT ATC TGG GGC CAA GGG ACA ATG GTC ACC GTC

S   S
358   TCT TCA
```

Fig. 1A

Anti-CD73 CD73.4-1 VK

V segment: VK3 / L20
J segment: JK4 / 4

```
     E    I    V    L    T    Q    S    P    A    T    L    S    L    S    P    G    E
 1   GAA  ATT  GTG  TTG  ACA  CAG  TCT  CCA  GCC  ACC  CTG  TCT  TTG  TCT  CCA  GGG  GAA
                                             CDR1
     R    A    T    L    S    C    R    A    S    Q    G    V    S    S    Y    L    A
 52  AGA  GCC  ACC  CTC  TCC  TGC  AGG  GCC  AGT  CAG  GGT  GTT  AGC  AGC  TAC  TTA  GCC
                                                                              CDR2
     W    Y    Q    Q    K    P    G    Q    A    P    R    L    L    I    Y    D    A
103  TGG  TAC  CAG  CAG  AAA  CCT  GGC  CAG  GCT  CCC  AGG  CTC  CTC  ATC  TAT  GAT  GCA

S    N    R    A    T    G    I    P    A    R    F    S    G    S    G    P    G
154  TCC  AAC  AGG  GCC  ACT  GGC  ATC  CCA  GCC  AGG  TTC  AGT  GGC  AGT  GGG  CCT  GGG

T    D    F    T    L    T    I    S    S    L    E    P    E    D    F    A    V
205  ACA  GAC  TTC  ACT  CTC  ACC  ATC  AGC  AGC  CTA  GAG  CCT  GAA  GAT  TTT  GCA  GTT
          CDR3
     Y    Y    C    Q    Q    R    S    N    W    H    L    T    F    G    G    G    T
256  TAT  TAC  TGT  CAG  CAG  CGT  AGC  AAC  TGG  CAT  CTC  ACT  TTC  GGC  GGA  GGG  ACC

K    V    E    I    K
307  AAG  GTG  GAG  ATC  AAA
```

Fig. 1B

Anti-CD73 CD73.4-2 VH

V segment: VH3 / 3-33
D segment: D6 / 6-13
J segment: JH3 / 3

```
      Q    V    Q    L    V    E    S    G    G    G    V    V    Q    P    G    R    S
1     CAG  GTG  CAG  CTG  GTG  GAG  TCT  GGG  GGA  GGC  GTG  GTC  CAG  CCT  GGG  AGG  TCC
                                                                        CDR1
      L    R    L    S    C    A    A    S    G    F    T    F    S    N    Y    G    M
52    CTG  AGA  CTC  TCC  TGT  GCA  GCC  TCT  GGA  TTC  ACC  TTC  AGT  AAC  TAT  GGC  ATG
                                                                             CDR2
      H    W    V    R    Q    A    P    G    K    G    L    E    W    V    A    V    I
103   CAC  TGG  GTC  CGC  CAG  GCT  CCA  GGC  AAG  GGG  CTG  GAG  TGG  GTG  GCA  GTT  ATA

L    Y    D    G    S    N    K    Y    Y    P    D    S    V    K    G    R    F
154   TTG  TAT  GAT  GGA  AGT  AAT  AAA  TAC  TAT  CCA  GAC  TCC  GTG  AAG  GGC  CGA  TTC

T    I    S    R    D    N    S    K    N    T    L    Y    L    Q    M    N    S
205   ACC  ATC  TCC  AGA  GAC  AAT  TCC  AAG  AAC  ACG  CTG  TAT  CTG  CAA  ATG  AAC  AGC
                                                                   CDR3
      L    R    A    E    D    T    A    V    Y    Y    C    A    R    G    G    S    S
256   CTG  AGA  GCC  GAG  GAC  ACG  GCT  GTG  TAT  TAC  TGT  GCG  AGA  GGG  GGC  AGC  AGC

W    Y    P    D    S    F    D    I    W    G    Q    G    T    M    V    T    V
307   TGG  TAC  CCT  GAT  TCT  TTT  GAT  ATC  TGG  GGC  CAA  GGG  ACA  ATG  GTC  ACC  GTC

S    S
358   TCT  TCA
```

*Fig. 2A*

Anti-CD73 CD73.4-2 VK

V segment: VK1 / L15
J segment: JK4 / 4

```
      D   I   Q   M   T   Q   S   P   S   S   L   S   A   S   V   G   D
  1  GAC ATC CAG ATG ACC CAG TCT CCA TCA TCC CTG TCT GCA TCT GTA GGA GAC

CDR1
      R   V   T   I   T   C   R   A   S   Q   G   I   S   S   W   L   A
 52  AGA GTC ACC ATC ACT TGT CGG GCG AGT CAG GGT ATT AGC AGC TGG TTA GCC

CDR2
      W   Y   Q   Q   K   P   E   K   A   P   K   S   L   I   Y   A   A
103  TGG TAT CAG CAG AAA CCA GAG AAA GCC CCT AAG TCC CTG ATC TAT GCT GCA

S   S   L   Q   S   G   V   P   S   R   F   S   G   S   G   S   G
154  TCC AGT TTG CAA AGT GGG GTC CCA TCA AGG TTC AGC GGC AGT GGA TCT GGG

T   D   F   T   L   T   I   S   S   L   Q   P   E   D   F   A   T
205  ACA GAT TTC ACT CTC ACC ATC AGC AGC CTG CAG CCT GAA GAT TTT GCA ACT

CDR3
      Y   Y   C   Q   Q   Y   N   S   Y   P   L   T   F   G   G   G   T
256  TAT TAC TGC CAA CAG TAT AAT AGT TAC CCT CTC ACT TTC GGC GGA GGG ACC

K   V   E   I   K
307  AAG GTG GAG ATC AAA
```

Fig. 2B

Anti-CD73 11F11-1 VH

V segment: VH3 / 3-33
D segment: D6 / 6-13
J segment: JH3 / 3

```
  1   Q   V   Q   L   V   E   S   G   G   V   V   Q   P   G   R   S
      CAG GTG CAG CTG GTG GAG TCT GGG GGA GTG GTC CAG CCT GGG AGG TCC

CDR1
 52   L   R   L   S   C   A   T   S   G   F   T   F   S   N   Y   G   M
      CTG AGA CTC TCC TGT GCA ACG TCT GGA TTC ACC TTC AGT AAC TAT GGC ATG

103   H   W   V   R   Q   A   P   G   K   G   L   E   W   V   A   V   I
      CAC TGG GTC CGC CAG GCT CCA GGC AAG GGG CTG GAG TGG GTG GCA GTT ATA
                                                                   CDR2

154   L   Y   D   G   S   N   K   Y   Y   P   D   S   V   K   G   R   F
      TTG TAT GAT GGA AGT AAT AAA TAC TAT CCA GAC TCC GTG AAG GGC CGA TTC

205   T   I   S   R   D   N   S   K   N   T   L   Y   L   Q   M   N   S
      ACC ATC TCC AGA GAC AAT TCC AAG AAC ACG CTG TAT CTG CAA ATG AAC AGC

256   L   R   A   E   D   T   A   V   Y   Y   C   A   R   G   G   S   S
      CTG AGA GCC GAG GAC ACG GCT GTG TAT TAC TGT GCG AGA GGG GGC AGC AGC
                                                           CDR3

307   W   Y   P   D   S   F   D   I   W   G   Q   G   T   M   V   T   V
      TGG TAC CCT GAT TCT TTT GAT ATC TGG GGC CAA GGG ACA ATG GTC ACC GTC

358   S   S
      TCT TCA
```

Fig. 3A

Anti-CD73 11F11-1 VK

V segment: VK3 / L20
J segment: JK4 / 4

```
                                                                                              CDR1
  1  E    I    V    L    T    Q    S    P    A    T    L    S    L    S    P    G    E
     GAA  ATT  GTG  TTG  ACA  CAG  TCT  CCA  GCC  ACC  CTG  TCT  TTG  TCT  CCA  GGG  GAA

52  R    A    T    L    S    C    R    A    S    Q    G    V    S    S    Y    L    A
     AGA  GCC  ACC  CTC  TCC  TGC  AGG  GCC  AGT  CAG  GGT  GTT  AGC  AGC  TAC  TTA  GCC

CDR2
103  W    Y    Q    Q    K    P    G    Q    A    P    R    L    L    I    Y    D    A
     TGG  TAC  CAG  CAG  AAA  CCT  GGC  CAG  GCT  CCC  AGG  CTC  CTC  ATC  TAT  GAT  GCA

154  S    N    R    A    T    G    I    P    A    R    F    S    G    S    G    P    G
     TCC  AAC  AGG  GCC  ACT  GGC  ATC  CCA  GCC  AGG  TTC  AGT  GGC  AGT  GGG  CCT  GGG

205  T    D    F    T    L    T    I    S    S    L    E    P    E    D    F    A    V
     ACA  GAC  TTC  ACT  CTC  ACC  ATC  AGC  AGC  CTA  GAG  CCT  GAA  GAT  TTT  GCA  GTT

CDR3
256  Y    Y    C    Q    Q    R    S    N    W    H    L    T    F    G    G    G    T
     TAT  TAC  TGT  CAG  CAG  CGT  AGC  AAC  TGG  CAT  CTC  ACT  TTC  GGC  GGA  GGG  ACC

307  K    V    E    I    K
     AAG  GTG  GAG  ATC  AAA
```

Fig. 3B

Anti-CD73 11F11-2 VH

V segment: VH3 / 3-33
D segment: D6 / 6-13
J segment: JH3 / 3

```
                                                              CDR1
  1  Q   V   Q   L   V   E   S   G   G   G   V   V   Q   P   G   R   S
     CAG GTG CAG CTG GTG GAG TCT GGG GGA GGC GTG GTC CAG CCT GGG AGG TCC

M
 52  L   R   L   S   C   A   T   S   G   F   T   F   S   N   Y   G   M
     CTG AGA CTC TCC TGT GCA ACG TCT GGA TTC ACC TTC AGT AAC TAT GGC ATG
                                                                 CDR2
                                                                 V   I
103  H   W   V   R   Q   A   P   G   K   G   L   E   W   V   A   V   I
     CAC TGG GTC CGC CAG GCT CCA GGC AAG GGG CTG GAG TGG GTG GCA GTT ATA

154  L   Y   D   G   S   N   K   Y   Y   P   D   S   V   K   G   R   F
     TTG TAT GAT GGA AGT AAT AAA TAC TAT CCA GAC TCC GTG AAG GGC CGA TTC

205  T   I   S   R   D   N   S   K   N   T   L   Y   L   Q   M   N   S
     ACC ATC TCC AGA GAC AAT TCC AAG AAC ACG CTG TAT CTG CAA ATG AAC AGC
                                                                 CDR3
                                                                 G   G   S   S
256  L   R   A   E   D   T   A   V   Y   Y   C   A   R   G   G   S   S
     CTG AGA GCC GAG GAC ACG GCT GTG TAT TAC TGT GCG AGA GGG GGC AGC AGC

307  W   Y   P   D   S   F   D   I   W   G   Q   G   T   M   V   T   V
     TGG TAC CCT GAT TCT TTT GAT ATC TGG GGC CAA GGG ACA ATG GTC ACC GTC

358  S   S
     TCT TCA
```

*Fig. 4A*

Anti-CD73 11F11-2 VK

V segment: VK1 / L15
J segment: JK4 / 4

```
  1  D   I   Q   M   T   Q   S   P   S   S   L   S   A   S   V   G   D
     GAC ATC CAG ATG ACC CAG TCT CCA TCC TCA CTG TCT GCA TCT GTA GGA GAC
                                      ┌─CDR1─────────────────────────────
 52  R   V   T   I   T   C   R   A   S   Q   G   I   S   S   W   L   A
     AGA GTC ACC ATC ACT TGT CGG GCG AGT CAG GGT ATT AGC AGC TGG TTA GCC
     ─────────────────┐                                        ┌─CDR2────
103  W   Y   Q   Q   K   P   E   K   A   P   K   S   L   I   Y   A   A
     TGG TAT CAG CAG AAA CCA GAG AAA GCC CCT AAG TCC CTG ATC TAT GCT GCA
     ──────┐
154  S   S   L   Q   S   G   V   P   S   R   F   S   G   S   G   S   G
     TCC AGT TTG CAA AGT GGG GTC CCA TCA AGG TTC AGC GGC AGT GGA TCT GGG

205  T   D   F   T   L   T   I   S   S   L   Q   P   E   D   F   A   T
     ACA GAT TTC ACT CTC ACC ATC AGC AGC CTG CAG CCT GAA GAT TTT GCA ACT
                      ┌─CDR3────────────────────────┐
256  Y   Y   C   Q   Q   Y   N   S   Y   P   L   T   F   G   G   G   T
     TAT TAC TGC CAA CAG TAT AAT AGT TAC CCT CTC ACT TTC GGC GGA GGG ACC

307  K   V   E   I   K
     AAG GTG GAG ATC AAA
```

*Fig. 4B*

Anti-CD73 4C3-1 VH

V segment: VH3 / 3-09
D segment: D3 / 3-9
J segment: JH4 / 4

```
      E   V   Q   L   V   E   S   G   G   G   L   V   Q   P   G   R   S
1     GAA GTG CAG CTG GTG GAG TCT GGG GGA GGC TTG GTA CAG CCT GGC AGG TCC

┌─CDR1──────
      L   R   L   S   C   A   A   S   G   F   T   F   D   │ D   Y   A   M
52    CTG AGA CTC TCC TGT GCA GCC TCT GGA TTC ACC TTT GAT │ GAT TAT GCC ATG

─┐
      H │ W   V   R   Q   A   P   G   K   G   L   E   W   V   S
103   CAC│ TGG GTC CGG CAA GCT CCA GGG AAG GGG CTG GAG TGG GTC TCA
                                                               ┌─CDR2────
                                                               │G   I
      S   I   G   Y   A   D   S   V   K   G   R   F
154   AGT ATA GGT TAT GCG GAC TCT GTG AAG GGC CGA TTC
      ─┐
                                                                ─
      T   I   S   R   D   N   A   K   N   S   L   Y   L   Q   M │ N   S
205   ACC ATC TCC AGA GAC AAC GCC AAG AAC TCC CTG TAT CTG CAA ATG│ AAC AGT
                                                            ┌─CDR3─
      L   R   A   E   D   T   A   L   Y   Y   C   V   K │ G   Y   Y   V
256   CTG AGA GCT GAG GAC ACG GCC TTG TAT TAC TGT GTA AAA│ GGG TAT TAC GTT

─┐
      I   L   T   G   L   D   Y │ W   G   Q   G   T   L   V   T   V   S
307   ATT TTG ACT GGC CTT GAC TAC│ TGG GGC CAG GGA ACC CTG GTC ACC GTC TCC

S
358   TCA
```

*Fig. 5A*

Anti-CD73 4C3-1 VK

V segment: VK3 / A27
J segment: JK4 / 4

```
    E   I   V   L   T   Q   S   P   G   T   L   S   L   S   P   G   E
1   GAA ATT GTG TTG ACG CAG TCT CCA GGC ACC CTG TCT TTG TCT CCA GGG GAA

R   A   T   L   S   C   R   A   S   Q   S   V   S   S   Y   L
                                      ─────CDR1──────────────────
52  AGA GCC ACC CTC TCC TGC AGG GCC AGT CAG AGT GTT AGC AGC ... TAC TTA

A   W   Y   Q   Q   K   P   G   Q   A   P   R   L   L   I   Y   G
103 GCC TGG TAC CAG CAG AAA CCT GGC CAG GCT CCC AGG CTC CTC ATC TAT GGT

──CDR2──
    A   S   S   R   A   T   G   I   P   D   R   F   S   G   S   G   S
154 GCA TCC AGC AGG GCC ACT GGC ATC CCA GAC AGG TTC AGT GGC AGT GGG TCT

G   T   D   F   T   L   T   I   S   R   L   E   P   E   D   F   A
205 GGG ACA GAC TTC ACT CTC ACC ATC AGC AGA CTG GAG CCT GAA GAT TTT GCA

V   Y   Y   C   Q   Q   Y   G   S   S   P   L   T   F   G   G   G
                        ───────CDR3──────────────
256 GTG TAT TAC TGT CAG CAG TAT GGT AGC TCA CCG CTC ACT TTC GGC GGA GGG

T   K   V   E   I   K
307 ACC AAG GTG GAG ATC AAA
```

*Fig. 5B*

Anti-CD73 4C3-2 VH

V segment: VH3 / 3-09
D segment: D3 / 3-9
J segment: JH4 / 4

```
1    E   V   Q   L   V   E   S   G   G   G   L   V   Q   P   G   R   S
     GAA GTG CAG CTG GTG GAG TCT GGG GGA GGC TTG GTA CAG CCT GGC AGG TCC

CDR1
                                                              ┌─  D   Y   A   M
52   L   R   L   S   C   A   A   S   G   F   T   F   D   D   Y   A   M
     CTG AGA CTC TCC TGT GCA GCC TCT GGA TTC ACC TTT GAT GAT TAT GCC ATG

103  H   W   V   R   Q   A   P   G   K   G   L   E   W   V   S
     CAC TGG GTC CGG CAA GCT CCA GGG AAG GGG CTG GAG TGG GTC TCA
                                                              ─┘
                                                              CDR2
                                                              ┌─  G   I
154  S   W   K   S   G   S   I   G   Y   A   D   S   V   K   G   I
     AGT TGG AAG AGT GGT AGC ATA GGC TAT GCG GAC TCT GTG AAG GGC CGA
                                                                    ─┘
                                                              R   F
                                                              TTC

205  T   I   S   R   D   N   A   K   N   S   L   Y   L   Q   M   N   S
     ACC ATC TCC AGA GAC AAC GCC AAG AAC TCC CTG TAT CTG CAA ATG AAC AGT

CDR3
                                                              ┌─  G   Y   Y   V
256  L   R   A   E   D   T   A   L   Y   Y   C   V   K   G   Y   Y   V
     CTG AGA GCT GAG GAC ACG GCC TTG TAT TAC TGT GTA AAA GGG TAT TAC GTT

307  I   L   T   G   L   D   Y   W   G   Q   G   T   L   V   T   V   S
     ATT TTG ACT GGC CTT GAC TAC TGG GGC CAG GGA ACC CTG GTC ACC GTC TCC
     ─┘

358  S
     TCA
```

Fig. 6A

Anti-CD73 4C3-2 VK

V segment: VK1 / L15
J segment: JK1 / 1

```
  1   D   I   Q   M   T   Q   S   P   S   S   L   S   A   S   V   G   D
      GAC ATC CAG ATG ACC CAG TCT CCA TCC TCA CTG TCT GCA TCT GTA GGA GAC

CDR1
 52   R   V   T   F   T   C   R   A   S   Q   G   I   S   S   W   L   A
      AGA GTC ACC TTC ACT TGT CGG GCG AGT CAG GGT ATT AGC AGC TGG TTA GCC

CDR2
103   W   Y   Q   Q   K   P   E   K   A   P   K   S   L   I   Y   A   A
      TGG TAT CAG CAG AAA CCA GAG AAA GCC CCT AAG TCC CTG ATC TAT GCT GCA

154   S   S   L   Q   S   G   V   P   S   R   F   S   G   S   G   S   G
      TCC AGT TTG CAA AGT GGG GTC CCA TCA AGG TTC AGC GGC AGT GGA TCT GGG

205   T   D   F   T   L   T   I   S   S   L   Q   P   E   D   F   A   T
      ACA GAT TTC ACT CTC ACC ATC AGC AGC CTG CAG CCT GAA GAT TTT GCA ACT

CDR3
256   Y   Y   C   Q   Q   Y   N   S   Y   P   P   T   F   G   Q   G   T
      TAT TAC TGC CAA CAG TAT AAT AGT TAC CCT CCA ACG TTC GGC CAG GGG ACC

307   K   V   E   I   K
      AAG GTG GAA ATC AAA
```

*Fig. 6B*

Anti-CD73 4C3-3 VH

V segment: VH3 / 3-09
D segment: D3 / 3-9
J segment: JH4 / 4

```
      E   V   Q   L   V   E   S   G   G   G   L   V   Q   P   G   R   S
  1   GAA GTG CAG CTG GTG GAG TCT GGG GGA GGC TTG GTA CAG CCT GGC AGG TCC
                                                              CDR1
      L   R   L   S   C   A   A   S   G   F   T   F   D   D   Y   A   M
 52   CTG AGA CTC TCC TGT GCA GCC TCT GGA TTC ACC TTT GAT GAT TAT GCC ATG

H   W   V   R   Q   A   P   G   K   G   L   E   W   V   S   G   I
103   CAC TGG GTC CGG CAA GCT CCA GGG AAG GGC CTG GAG TGG GTC TCA GGT ATT
                                                                  CDR2
      S   W   K   S   G   S   I   G   Y   A   D   S   V   K   G   R   F
154   AGT TGG AAG AGT GGT AGT ATA GGC TAT GCG GAC TCT GTG AAG GGC CGA TTC

T   I   S   R   D   N   A   K   N   S   L   Y   L   Q   M   N   S
205   ACC ATC TCC AGA GAC AAC GCC AAG AAC TCC CTG TAT CTG CAA ATG AAC AGT

L   R   A   E   D   T   A   L   Y   Y   C   V   K   G   Y   Y   V
256   CTG AGA GCT GAG GAC ACG GCC TTG TAT TAC TGT GTA AAA GGG TAT TAC GTT
                                                          CDR3
      I   L   T   G   L   D   Y   W   G   Q   G   T   L   V   T   V   S
307   ATT TTG ACT GGC CTT GAC TAC TGG GGC CAG GGA ACC CTG GTC ACC GTC TCC

S
358   TCA
```

*Fig. 7A*

Anti-CD73 4C3-3 VK

V segment: VK1 / L15
J segment: JK1 / 1

```
                                                                                         CDR1
      D   I   Q   M   T   Q   S   P   S   S   L   S   A   S   V   G   D
  1  GAC ATC CAG ATG ACC CAG TCT CCA TCC TCA CTG TCT GCA TCT GTA GGA GAC

R   V   T   F   T   C   R   A   S   Q   G   I   S   S   W   L   A
 52  AGA GTC ACC TTC ACT TGT CGG GCG AGT CAG GGT ATT AGC AGC TGG TTA GCC

CDR2
      W   Y   Q   Q   K   P   E   K   A   P   K   S   L   I   Y   A   A
103  TGG TAT CAG CAG AAA CCA GAG AAG GCC CCT AAG TCC CTG ATC TAT GCT GCA
                                             CDR3
      S   S   L   Q   S   G   V   P   S   R   F   S   G   S   G   S   G
154  TCC AGT TTG CAA AGT GGG GTC CCA TCA AGG TTC AGC GGC AGT GGA TCT GGG

T   D   F   T   L   T   I   S   S   L   Q   P   E   D   F   A   T
205  ACA GAT TTC ACT CTC ACC ATC AGC AGC CTG CAG CCT GAA GAT TTT GCA ACT

Y   Y   C   Q   Q   Y   N   S   Y   P   P   T   F   G   Q   G   T
256  TAT TAC TGC CAA CAG TAT AAT AGT TAC CCT CCA ACG TTC GGC CAA GGG ACC

K   V   E   I   K
307  AAG GTG GAA ATC AAA
```

Fig. 7B

Anti-CD73 4D4-1 VH

V segment: VH3 / 3-33
D segment: D6 / 6-13
J segment: JH3 / 3

```
       Q    V    Q    L    V    E    S    G    G    G    V    V    Q    P    G    R    S
  1   CAG  GTG  CAG  CTG  GTG  GAG  TCT  GGG  GGA  GGC  GTG  GTC  CAG  CCT  GGG  AGG  TCC

L    R    L    S    C    A    A    S    G    F    T    F    S   N    Y    G    M
                                                                          ─────CDR1─────
 52   CTG  AGA  CTC  TCC  TGT  GCA  GCG  TCT  GGA  TTC  ACC  TTC  AGT  AAT  TAT  GGC  ATG

H    W    V    R    Q    A    P    G    K    G    L    E    W    V    A   V    I
                                                                                  ──CDR2
103   CAC  TGG  GTC  CGC  CAG  GCT  CCA  GGC  AAG  GGG  CTG  GAG  TGG  GTG  GCA  GTT  ATA

W    Y    D    E    S    N    K    Y    Y    A    D    S    V    K    G    R    F
      ─────                                                                              
154   TGG  TAT  GAT  GAA  AGT  AAT  AAA  TAC  TAT  GCA  GAC  TCC  GTG  AAG  GGC  CGA  TTC

T    I    S    R    D    N    S    K    N    T    L    F    L    Q    M    N    S
205   ACC  ATC  TCC  AGA  GAC  AAT  TCC  AAG  AAC  ACG  CTG  TTT  CTG  CAA  ATG  AAC  AGC

L    R    A    E    D    T    A    V    Y    Y    C    A    R   G    Y    N    S
                                                                            ─────CDR3
256   CTG  AGA  GCC  GAG  GAC  ACG  GCT  GTG  TAT  TAT  TGT  GCG  AGA  GGG  TAT  AAC  AGC

R    W    Y    P    D    A    F    D    I    W    G    Q    G    T    M    V    T
307   AGG  TGG  TAC  CCT  GAT  GCT  TTT  GAT  ATC  TGG  GGC  CAA  GGG  ACA  ATG  GTC  ACC

V    S    S
358   GTC  TCT  TCA
```

Fig. 8A

Anti-CD73 4D4-1 VK

V segment: VK1 / L15
J segment: JK4 / 4

```
      D   I   Q   M   T   Q   S   P   S   S   L   S   A   S   V   G   D
  1  GAC ATC CAG ATG ACC CAG TCT CCA TCC TCA CTG TCT GCA TCT GTA GGA GAC
                                      CDR1
      R   V   T   I   T   C   R   A   S   Q   G   I   S   S   W   L   A
 52  AGA GTC ACC ATC ACT TGT CGG GCG AGT CAG GGT ATT AGC AGC TGG TTA GCC
                                                                   CDR2
      W   Y   Q   Q   K   P   E   K   A   P   K   S   L   I   Y   A   A
103  TGG TAT CAG CAG AAA CCA GAG AAA GCC CCT AAG TCC CTG ATC TAT GCT GCA

S   S   L   Q   S   G   V   P   S   R   F   S   G   S   G   S   G
154  TCC AGT TTG CAA AGT GGG GTC CCA TCA AGG TTC AGC GGC AGT GGA TCT GGG

T   D   F   T   L   T   I   S   S   L   Q   P   E   D   F   A   T
205  ACA GAT TTC ACT CTC ACC ATC AGC AGC CTG CAG CCT GAA GAT TTT GCA ACT
                 CDR3
      Y   Y   C   Q   Q   Y   N   S   Y   P   L   T   F   G   G   G   T
256  TAT TAC TGC CAA CAG TAT AAT AGT TAC CCG CTC ACT TTC GGC GGA GGG ACC

K   V   E   I   K
307  AAG GTG GAG ATC AAA
```

*Fig. 8B*

Anti-CD73 10D2-1 VH

V segment: VH3 / 3-33
D segment: D6 / 6-13
J segment: JH6 / 6

```
       Q   V   Q   L   V   E   S   G   G   V   V   Q   P   G   R   S
  1    CAG GTG CAG CTG GTG GAG TCT GGG GGA GTC CAG CCT GGG AGG TCC
                                                           ┌──CDR1─────
       L   R   L   S   C   A   A   S   G   F   T   F   S   N   Y   G   L
 52    CTG AGA CTC TCC TGT GCA GCG TCT GGA TTC ACC TTC AGT AAC TAT GGC CTG
       ─────────────────┐                                              ┌CDR2
       H   W   V   R   Q   A   P   G   K   G   L   E   W   V   A   V   I
103    CAC TGG GTC CGC CAG GCT CCA GGC AAG GGG CTG GAG TGG GTG GCA GTT ATA
       ──────────────────────────────────────┐
       R   Y   D   G   S   N   K   Y   Y   A   D   S   V   K   G   R   F
154    CGG TAT GAT GGA AGT AAT AAA TAC TAT GCA GAC TCC GTG AAG GGC CGA TTC

T   I   S   R   D   N   S   K   N   T   L   Y   L   Q   M   S   S
205    ACC ATC TCC AGA GAC AAT TCC AAG AAC ACG CTG TAT CTG CAA ATG AGC AGC
                                                                 ┌──CDR3
       L   R   A   E   D   T   A   V   Y   Y   C   A   R   G   G   S   S
256    CTG AGA GCC GAG GAC ACG GCT GTG TAT TAC TGT GCG AGG GGG GGC AGC AGC
                                       ┘
       W   Y   P   D   G   L   D   V   W   G   Q   G   T   T   V   T   V
307    TGG TAC CCG GAC GGT TTG GAC GTC TGG GGC CAA GGG ACC ACG GTC ACC GTC

S   S
358    TCC TCA
```

Fig. 9A

Anti-CD73 10D2-1 VK

V segment: VK1 / L18
J segment: JK4 / 4

```
  1  A   I   Q   L   T   Q   S   P   S   S   L   S   A   S   V   G   D
     GCC ATC CAG TTG ACC CAG TCT CCA TCC TCT CTG TCT GCA TCT GTA GGA GAC

─────────────CDR1─────────────
 52  R   V   T   I   T   C   R   A   S   Q   G   I   S   S   A   L   A
     AGA GTC ACC ATC ACT TGC CGG GCA AGT CAG GGC ATT AGC AGT GCT TTA GCC

──CDR2──
103  W   Y   Q   Q   K   P   G   K   A   P   K   L   L   I   Y   D   A
     TGG TAT CAG CAG AAA CCA GGG AAA GCT CCT AAG CTC CTG ATC TAT GAT GCC

154  S   S   L   E   S   G   V   P   S   R   F   S   G   S   G   S   G
     TCC AGT TTG GAA AGT GGG GTC CCA TCA AGG TTC AGC GGC AGT GGA TCT GGG

205  T   D   F   T   L   T   I   S   S   L   Q   P   E   D   F   A   T
     ACA GAT TTC ACT CTC ACC ATC AGC AGC CTG CAG CCT GAA GAT TTT GCA ACT

─────────CDR3─────────
256  Y   Y   C   Q   Q   F   N   S   Y   P   T   F   G   G   G   T   K
     TAT TAC TGT CAA CAG TTT AAT AGT TAC CCC ACT TTC GGC GGA GGG ACC AAG

307  V   E   I   K
     GTG GAG ATC AAA
```

Fig. 9B

Anti-CD73 10D2-2 VH

V segment: VH3 / 3-33
D segment: D6 / 6-13
J segment: JH6 / 6

```
      Q   V   Q   L   V   E   S   G   G   V   V   Q   P   G   R   S
1     CAG GTG CAG CTG GTG GAG TCT GGG GGA GTC GTG CAG CCT GGG AGG TCC
                                                          CDR1
      L   R   L   S   C   A   A   S   G   F   T   F   S   N   Y   G   L
52    CTG AGA CTC TCC TGT GCA GCG TCT GGA TTC ACC TTC AGT AAC TAT GGC CTG
                                                                      CDR2
      H   W   V   R   Q   A   P   G   K   G   L   E   W   V   A   V   I
103   CAC TGG GTC CGC CAG GCT CCA GGC AAG GGG CTG GAG TGG GTG GCA GTT ATA
      R   Y   D   G   S   N   K   Y   Y   A   D   S   V   K   G   R   F
154   CGG TAT GAT GGA AGT AAT AAA TAC TAT GCA GAC TCC GTG AAG GGC CGA TTC
      T   I   S   R   D   N   S   K   N   T   L   Y   L   Q   M   S   S
205   ACC ATC TCC AGA GAC AAT TCC AAG AAC ACG CTG TAT CTG CAA ATG AGC AGC
                                                          CDR3
      L   R   A   E   D   T   A   V   Y   Y   C   A   R   G   G   S   S
256   CTG AGA GCC GAG GAC ACG GCT GTG TAT TAC TGT GCG AGG GGG GGC AGC AGC
      W   Y   P   D   G   L   D   V   W   G   Q   G   T   T   V   T   V
307   TGG TAC CCG GAC GGT TTG GAC GTC TGG GGC CAA GGG ACC ACG GTC ACC GTC
      S   S
358   TCC TCA
```

*Fig. 10A*

Anti-CD73 10D2-2 VK

V segment: VK1 / L15
J segment: JK4 / 4

```
  1   D   I   Q   M   T   Q   S   P   S   S   L   S   A   S   V   G   D
      GAC ATC CAG ATG ACC CAG TCT CCA TCC TCA CTG TCT GCA TCT GTA GGA GAC

CDR1
 52   R   V   T   I   T   C   R   A   S   Q   G   I   S   S   W   L   A
      AGA GTC ACC ATC ACT TGT CGG GCG AGT CAG GGT ATT AGC AGC TGG TTA GCC

CDR2
103   W   Y   Q   Q   K   P   E   K   A   P   K   S   L   I   Y   A   A
      TGG TAT CAG CAG AAA CCA GAG AAA GCC CCT AAG TCC CTG ATC TAT GCT GCA

154   S   S   L   Q   S   G   V   P   S   R   F   S   G   S   G   S   G
      TCC AGT TTG CAA AGT GGG GTC CCA TCA AGG TTC AGC GGC AGT GGA TCT GGG

205   T   D   F   T   L   T   I   S   S   L   Q   P   E   D   F   A   T
      ACA GAT TTC ACT CTC ACC ATC AGC AGC CTG CAG CCT GAA GAT TTT GCA ACT

CDR3
256   Y   Y   C   Q   Q   Y   N   S   Y   P   L   T   F   G   G   G   T
      TAT TAC TGC CAA CAG TAT AAT AGT TAC CCG CTC ACT TTC GGC GGA GGG ACC

307   K   V   E   I   K
      AAG GTG GAG ATC AAA
```

*Fig. 10B*

Anti-CD73 11A6-1 VH

V segment: VH3 / 3-09
D segment: D3 / 3-9
J segment: JH4 / 4

```
  1  E   V   Q   L   V   E   S   G   G   N   L   V   Q   P   G   R   S
     GAA GTG CAG CTG GTG GAA TCT GGG GGA AAC TTG GTA CAG CCT GGC AGG TCC

CDR1
 52  L   R   L   S   C   A   A   S   G   F   T   F   D   D   Y   A   M
     CTG AGA CTC TCC TGT GCA GCC TCT GGA TTC ACC TTT GAT GAT TAT GCC ATG

CDR2
103  H   W   V   R   Q   A   P   G   K   G   L   E   W   V   S   G   I
     CAC TGG GTC CGG CAA GCT CCA GGG AAG GGC CTG GAG TGG GTC TCA GGT ATT

154  S   W   N   N   N   D   I   G   Y   A   D   S   V   K   G   R   F
     AGT TGG AAT AAT AAT GAC ATA GGC TAT GCG GAC TCT GTG AAG GGC CGA TTC

205  I   I   S   R   D   N   A   K   N   S   L   Y   L   Q   M   N   S
     ATC ATC TCC AGA GAC AAC GCC AAG AAC TCC CTG TAT CTG CAA ATG AAC AGT

CDR3
256  L   R   P   E   D   T   A   T   Y   Y   C   V   K   G   Y   Y   V
     CTG AGA CCT GAG GAC ACG GCC ACG TAT TAT TGT GTA AAA GGT TAT TAC GTT

307  I   L   T   G   L   D   Y   W   G   Q   G   T   P   V   T   V   S
     ATT TTG ACT GGT CTT GAC TAC TGG GGC CAG GGA ACC CCG GTC ACC GTC TCC

358  S
     TCA
```

Fig. 11A

Anti-CD73 11A6-1 VK

V segment: VK1 / L15
J segment: JK4 / 4

```
      D   I   Q   M   T   Q   S   P   S   S   L   S   A   S   V   G   D
  1  GAC ATC CAG ATG ACC CAG TCT CCA TCC TCA CTG TCT GCA TCT GTA GGA GAC
                                       ─────CDR1──────────────
      R   V   T   I   T   C   R   A   S   Q   G   I   S   S   W   L   A
 52  AGA GTC ACC ATC ACT TGT CGG GCG AGT CAG GGT ATT AGC AGC TGG TTA GCC
                                                                   ─CDR2─
      W   Y   Q   Q   K   P   E   K   A   P   K   S   L   I   Y   A   A
103  TGG TAT CAG CAG AAA CCA GAG AAA GCC CCT AAG TCC CTG ATC TAT GCT GCA
     ──
      S   S   L   Q   S   G   V   P   S   R   F   S   G   S   G   S   G
154  TCC AGT TTG CAA AGT GGG GTC CCA TCA AGG TTC AGC GGC AGT GGA TCT GGG

T   D   F   T   L   T   I   S   S   L   Q   P   E   D   F   A   T
205  ACA GAT TTC ACT CTC ACC ATC AGC AGC CTG CAG CCT GAA GAT TTT GCA ACT
                        ─────CDR3─────────
      Y   Y   C   Q   Q   Y   N   S   Y   P   L   T   F   G   G   G   T
256  TAT TAC TGC CAA CAG TAT AAT AGT TAC CCG CTC ACT TTC GGC GGA GGG ACC

K   V   E   I   K
307  AAG GTG GAG ATC AAA
```

*Fig. 11B*

Anti-CD73 24H2-1 VH

V segment: VH3 / 3-33
D segment: D6 / 6-13
J segment: JH3 / 3

```
       Q   V   Q   L   V   E   S   G   G   G   V   V   Q   P   G   R   S
  1   CAG GTG CAA CTG GTG GAG TCT GGG GGA GGC GTG GTC CAG CCT GGG AGG TCC

L   R   L   S   C   A   A   S   G   F   T   F   S   N   Y   G   M
                                                          ─────CDR1─────
 52   CTG AGA CTC TCC TGT GCA GCG TCT GGA TTC ACC TTC AGT AAC TAT GGC ATG

H   W   V   R   Q   A   P   G   K   G   L   E   W   V   A   V   I
                                                                  ──CDR2
103   CAC TGG GTC CGC CAG GCT CCA GGC AAG GGC CTG GAG TGG GTG GCA GTT ATA

W   Y   D   G   G   N   K   Y   Y   A   D   S   V   K   G   R   F
      ──────────────────────────────────
154   TGG TAT GAT GGA GGT AAT AAA TAC TAT GCA GAC TCC GTG AAG GGC CGA TTC

T   I   S   R   D   N   S   K   N   T   L   F   L   Q   M   N   S
205   ACC ATC TCC AGA GAC AAT TCC AAG AAC ACG CTG TTT CTG CAA ATG AAC AGC

L   R   A   E   D   T   A   V   Y   Y   C   A   R   G   G   S   S
                                                           ─────CDR3
256   CTG AGA GCC GAA GAC ACG GCT GTG TAT TAC TGT GCG AGA GGG GGC AGC AGC

W   Y   P   D   A   F   D   I   W   G   Q   G   T   M   V   T   V
307   TGG TAC CCT GAT GCT TTT GAT ATC TGG GGC CAA GGG ACA ATG GTC ACC GTC

S   S
358   TCT TCA
```

Fig. 12A

Anti-CD73 24H2-1 VK

V segment: VK1 / L15
J segment: JK4 / 4

```
       D   I   Q   M   T   Q   S   P   S   S   L   S   A   S   V   G   D
  1    GAC ATC CAG ATG ACC CAG TCT CCA TCC TCA CTG TCT GCA TCT GTA GGA GAC
                                          CDR1
       R   V   T   I   T   C   R   A   S   Q   G   I   S   S   W   L   A
  52   AGA GTC ACC ATC ACT TGT CGG GCG AGT CAG GGT ATT AGC AGC TGG TTA GCC
                                                                    CDR2
                                                                    A   A
       W   Y   Q   Q   K   P   E   K   A   P   K   S   L   I   Y   A   A
 103   TGG TAT CAG CAG AAA CCA GAG AAA GCC CCT AAG TCC CTG ATC TAT GCT GCA

S   S   L   Q   S   G   V   P   S   R   F   S   G   S   G   S   G
 154   TCC AGT TTG CAA AGT GGG GTC CCA TCA AGG TTC AGC GGC AGT GGA TCT GGG

T   D   F   T   L   T   I   S   S   L   Q   P   E   D   F   A   T
 205   ACA GAT TTC ACT CTC ACC ATC AGC AGC CTG CAG CCT GAA GAT TTT GCA ACT
           CDR3
       Y   Y   C   Q   Q   Y   N   S   Y   P   L   T   F   G   G   G   T
 256   TAT TAC TGC CAA CAG TAT AAT AGT TAC CCT CTC ACT TTC GGC GGA GGG ACC

K   V   E   I   K
 307   AAG GTG GAG ATC AAA
```

*Fig. 12B*

Anti-CD73 5F8-1 VH

V segment: VH3 / 3-74
D segment: D6 / 6-19
J segment: JH4 / 4

```
  1  E   V   Q   L   V   E   S   G   G   G   L   V   Q   P   G   G   S
     GAG GTG CAG CTG GTG GAG TCC GGG GGA GGC TTA GTT CAG CCT GGG GGG TCC

CDR1
 52  L   R   L   S   C   A   A   S   G   F   T   F   S   S   Y   W   M
     CTG AGA CTC TCC TGT GCA GCC TCT GGA TTC ACC TTC AGT AGC TAC TGG ATG

CDR2
103  H   W   V   R   Q   A   P   G   K   G   L   V   W   V   S   R   I
     CAC TGG GTC CGC CAA GCT CCA GGG AAG GGG CTG GTG TGG GTC TCA CGT ATT

154  I   S   D   G   S   S   T   G   Y   A   D   S   V   K   G   R   F
     ATT AGT GAT GGG AGT AGC ACA GGT TAC GCG GAT TCC GTG AAG GGC CGA TTC

205  T   I   S   R   D   N   A   K   N   T   L   Y   L   Q   M   N   S
     ACC ATC TCC AGA GAC AAC GCC AAG AAC ACG CTG TAT CTG CAA ATG AAC AGT

CDR3
256  L   R   A   E   D   T   A   V   Y   Y   C   A   R   E   F   S   S
     CTG AGA GCC GAG GAC ACG GCT GTG TAT TAC TGT GCA AGA GAG TTT AGC AGT

307  G   W   Y   F   D   Y   W   G   Q   G   T   L   V   T   V   S   S
     GGC TGG TAC TTT GAC TAC TGG GGC CAG GGA ACC CTG GTC ACC GTC TCC TCA
```

Fig. 13A

Anti-CD73 5F8-1 VK

V segment: VK1 / L18
J segment: JK1 / 1

```
     A   I   Q   L   T   Q   S   P   S   S   L   S   A   S   V   G   D
1    GCC ATC CAG TTG ACC CAG TCT CCA TCC TCC CTG TCT GCA TCT GTA GGA GAC

CDR1
     R   V   T   I   T   C   R   A   S   Q   G   I   S   S   A   L   A
52   AGA GTC ACC ATC ACT TGC CGG GCA AGT CAG GGC ATT AGC AGT GCT TTA GCC

CDR2
     W   Y   Q   Q   K   P   G   K   A   P   K   L   L   I   Y   D   A
103  TGG TAT CAG CAG AAA CCA GGG AAA GCT CCT AAG CTC CTG ATC TAT GAT GCC

S   S   L   E   S   G   V   P   S   R   F   S   G   S   G   S   G
154  TCC AGT TTG GAA AGT GGG GTC CCA TCA AGG TTC AGC GGC AGT GGA TCT GGG

T   D   F   T   L   T   I   S   S   L   Q   P   E   D   F   A   T
205  ACA GAT TTC ACT CTC ACC ATC AGC AGC CTG CAG CCT GAA GAT TTT GCA ACT

CDR3
     Y   Y   C   Q   Q   F   S   S   Y   P   R   T   F   G   Q   G   T
256  TAT TAC TGT CAA CAG TTT AGT AGT TAC CCT CGG ACG TTC GGC CAA GGG ACC

K   V   E   I   K
307  AAG GTG GAA ATC AAA
```

*Fig. 13B*

Anti-CD73 5F8-2 VH

V segment: VH3 / 3-74
D segment: D6 / 6-19
J segment: JH4 / 4

|     |     |     |     |     |     |     |     |     |     |     |     |     |     |     |     |     |
|-----|-----|-----|-----|-----|-----|-----|-----|-----|-----|-----|-----|-----|-----|-----|-----|-----|
|     | E   | V   | Q   | L   | V   | E   | S   | G   | G   | G   | L   | V   | Q   | P   | G   | G   | S   |
| 1   | GAG | GTG | CAG | CTG | GTG | GAG | TCC | GGG | GGA | GGC | TTA | GTT | CAG | CCT | GGG | GGG | TCC |
|     |     |     |     |     |     |     |     |     |     |     |     |     |     | CDR1|     |     |
|     | L   | R   | L   | S   | C   | A   | A   | S   | G   | F   | T   | F   | S   | S   | Y   | W   | M   |
| 52  | CTG | AGA | CTC | TCC | TGT | GCA | GCC | TCT | GGA | TTC | ACC | TTC | AGT | AGC | TAC | TGG | ATG |
|     |     |     |     |     |     |     |     |     |     |     |     |     |     |     |     | CDR2|     |
|     | H   | W   | V   | R   | Q   | A   | P   | G   | K   | G   | L   | V   | W   | V   | S   | R   | I   |
| 103 | CAC | TGG | GTC | CGC | CAA | GCT | CCA | GGG | AAG | GGG | CTG | GTG | TGG | GTC | TCA | CGT | ATT |
|     | I   | S   | D   | G   | S   | S   | T   | G   | Y   | A   | D   | S   | V   | K   | G   | R   | F   |
| 154 | ATT | AGT | GAT | GGG | AGT | AGC | ACA | GGT | TAC | GCG | GAT | TCC | GTG | AAG | GGC | CGA | TTC |
|     | T   | I   | S   | R   | D   | N   | A   | K   | N   | T   | L   | Y   | L   | Q   | M   | N   | S   |
| 205 | ACC | ATC | TCC | AGA | GAC | AAC | GCC | AAG | AAC | ACG | CTG | TAT | CTG | CAA | ATG | AAC | AGT |
|     | L   | R   | A   | E   | D   | T   | A   | V   | Y   | Y   | C   | A   | R   |     |     |     |     |
|     |     |     |     |     |     |     |     |     |     |     |     |     |     |     |     | CDR3|     |
|     |     |     |     |     |     |     |     |     |     |     |     |     |     | E   | F   | S   | S   |
| 256 | CTG | AGA | GCC | GAG | GAC | ACG | GCT | GTG | TAT | TAC | TGT | GCA | AGA | GAG | TTT | AGC | AGT |
|     | G   | W   | Y   | F   | D   | Y   | W   | G   | Q   | G   | T   | L   | V   | T   | V   | S   | S   |
| 307 | GGC | TGG | TAC | TTT | GAC | TAC | TGG | GGC | CAG | GGA | ACC | CTG | GTC | ACC | GTC | TCC | TCA |

Fig. 14A

Anti-CD73 5F8-2 VK

V segment: VK1 / L15
J segment: JK1 / 1

```
      D   I   Q   M   T   Q   S   P   S   S   L   S   A   S   V   G   D
  1   GAC ATC CAG ATG ACC CAG TCT CCA TCA TCC CTG TCT GCA TCT GTA GGA GAC

CDR1
      R   V   T   I   T   C   R   A   S   Q   G   I   S   S   W   L   A
 52   AGA GTC ACC ATC ACT TGT CGG GCG AGT CAG GGT ATT AGC AGC TGG TTA GCC

CDR2
      W   Y   Q   Q   K   P   E   K   A   P   K   S   L   I   Y   A   A
103   TGG TAT CAG CAG AAA CCA GAG AAA GCC CCT AAG TCC CTG ATC TAT GCT GCA

S   S   L   Q   S   G   V   P   S   R   F   S   G   S   G   S   G
154   TCC AGT TTG CAA AGT GGG GTC CCA TCA AGG TTC AGC GGC AGT GGA TCT GGG

T   G   F   T   L   T   I   S   S   L   Q   P   E   D   F   A   T
205   ACA GGT TTC ACT CTC ACC ATC AGC AGC CTG CAG CCT GAA GAT TTT GCA ACT

CDR3
      Y   Y   C   Q   Q   Y   N   S   Y   P   R   T   F   G   Q   G   T
256   TAT TAC TGC CAA CAG TAT AAT AGT TAC CCT CGG ACG TTC GGC CAA GGG ACC

K   V   E   I   K
307   AAG GTG GAA ATC AAA
```

*Fig. 14B*

Anti-CD73 5F8-3 VH

V segment: VH3 / 3-74
D segment: D6 / 6-19
J segment: JH4 / 4

```
      E   V   Q   L   V   E   S   G   G   G   L   V   Q   P   G   G   S
  1  GAG GTG CAG CTG GTG GAG TCC GGG GGA GGC TTA GTT CAG CCT GGG GGG TCC

┌──CDR1──────────
      L   R   L   S   C   A   A   S   G   F   T   F   S   S   Y   W   M
 52  CTG AGA CTC TCC TGT GCA GCC TCT GGA TTC ACC TTC AGT AGC TAC TGG ATG

──────┐                                           ┌──CDR2──
      H    W   V   R   Q   A   P   G   K   G   L   V   W   V   S   R   I
103  CAC  TGG GTC CGC CAA GCT CCA GGG AAG GGG CTG GTG TCA GTC TCA CGT ATT

I   S   D   G   S   S   T   G   Y   A   D   S   V   K   G   R   F
154  ATT AGT GAT GGG AGT AGC ACA GGT TAC GCG GAT TCC GTG AAG GGC CGA TTC

T   I   S   R   D   N   A   K   N   T   L   Y   L   Q   M   N   S
205  ACC ATC TCC AGA GAC AAC GCC AAG AAC ACG CTG TAT CTG CAA ATG AAC AGT

┌──CDR3─
      L   R   A   E   D   T   A   V   Y   Y   C   A   R   E   F   S   S
256  CTG AGA GCC GAG GAC ACG GCT GTG TAT TAC TGT GCA AGA GAG TTT AGC AGT

G   W   Y   F   D   Y   W   G   Q   G   T   L   V   T   V   S   S
307  GGC TGG TAC TTT GAC TAC TGG GGC CAG GGA ACC CTG GTC ACC GTC TCC TCA
```

Fig. 15A

Anti-CD73 5F8-3 VK

V segment: VK3 / L6
J segment: JK1 / 1

```
    E   I   V   L   T   Q   S   P   A   T   L   S   L   S   P   G   E
1   GAA ATT GTG TTG ACA CAG TCT CCA GCC ACC CTG TCT TTG TCT CCA GGG GAA

CDR1
    R   A   T   L   S   C   R   A   S   Q   S   V   S   S   Y   L   A
52  AGA GCC ACC CTC TCC TGC AGG GCC AGT CAG AGT GTT AGC AGC TAC TTA GCC

CDR2
    W   Y   Q   Q   K   P   G   Q   A   P   R   L   L   I   Y   D   A
103 TGG TAC CAA CAG AAA CCT GGC CAG GCT CCC AGG CTC CTC ATC TAT GAT GCA

S   N   R   A   T   G   I   P   A   R   F   S   G   S   G   S   G
154 TCC AAC AGG GCC ACT GGC ATC CCA GCC AGG TTC AGT GGC AGT GGG TCT GGG

T   D   F   T   L   T   I   S   S   L   E   P   E   D   F   A   V
205 ACA GAC TTC ACT CTC ACC ATC AGC AGC CTA GAG CCT GAA GAT TTT GCA GTT

CDR3
    Y   Y   C   Q   Q   R   S   N   W   T   F   G   Q   G   T   K
256 TAT TAC TGT CAG CAG CGT AGC AAC TGG ACG TTC GGC CAA GGG ACC AAG

V   E   I   K
307 GTG GAA ATC AAA
```

*Fig. 15B*

Anti-CD73 6E11-1 VH

V segment: VH3 / 3-09
D segment: D6 / 6-13
J segment: JH4 / 4

| | | | | | | | | | | | | | | | | | |
|---|---|---|---|---|---|---|---|---|---|---|---|---|---|---|---|---|---|
| 1 | E GAA | V GTG | Q CAG | L CTG | V GTG | E GAG | S TCT | G GGG | G GGA | A GCC | L TTG | V GTA | Q CAG | P CCT | G GGC | R AGG | S TCC |
| 52 | L CTG | R AGA | L CTC | S TCC | C TGT | A GCA | A TCT | S GCA | G GGA | F TTC | T ACC | F TTT | D GAT | CDR1 <br> D Y A M <br> GAT TAT GCC ATG | | | |
| 103 | H CAC | W TGG | V GTC | R CGG | Q CAA | A GCT | P CCA | G GGG | K AAG | G GGC | L CTG | E GAG | W TGG | V GTC | S TCA | CDR2 <br> G I <br> GGT ATT | |
| 154 | T ACT | W TGG | N AAT | S AGT | G GGT | G GGC | Y TAC | I ATA | G GGC | Y TAC | A GCG | D GAC | S TCT | V GTG | K AAG | G GGC | R CGA | F TTC |
| 205 | T ACC | I ATC | S TCC | R AGA | D GAC | N AAC | A GCC | K AAG | N AAC | S TCC | L CTG | Y TAT | L CTG | Q CAA | M ATG | N AAC | S AGT |
| 256 | L CTG | R AGA | A GCT | E GAG | D GAC | T ACG | A GCC | L TTG | Y TAT | Y TAT | C TGT | A GCA | K AAA | CDR3 <br> D R Y Y <br> GAT AGG TAT TAC | | | |
| 307 | S AGC | S AGT | W TGG | L CTC | F TTT | D GAC | N AAC | W TGG | G GGC | Q CAG | G GGA | I ATT | L CTG | V GTC | T ACC | V GTC | |
| 358 | S TCC | S TCA | | | | | | | | | | | | | | | |

Fig. 16A

Anti-CD73 6E11-1 VK

V segment: VK3 / A27
J segment: JK3 / 3

```
  1   E   I   V   L   T   Q   S   P   G   T   L   S   L   S   P   G   E
      GAA ATT GTG TTG ACG CAG TCT CCA GGC ACC CTG TCT TTG TCT CCA GGG GAA

CDR1
 52   R   A   T   L   S   C   R   A   S   Q   S   V   S   S   S   Y   L
      AGA GCC ACC CTC TCC TGC AGG GCC AGT CAG AGT GTT AGC AGC AGC TAC TTA

CDR2
103   A   W   Y   Q   Q   K   P   G   Q   A   P   R   L   L   I   Y   G
      GCC TGG TAC CAG CAG AAA CCT GGC CAG GCT CCC AGG CTC CTC ATC TAT GGT

154   A   S   S   R   A   T   G   I   P   D   R   F   S   G   S   G   S
      GCA TCC AGC AGG GCC ACT GGC ATC CCA GAC AGG TTC AGT GGC AGT GGG TCT

205   G   T   D   F   T   L   T   I   S   R   L   E   P   E   D   F   A
      GGG ACA GAC TTC ACT CTC ACC ATC AGC AGA CTG GAG CCT GAA GAT TTT GCA

CDR3
256   V   Y   Y   C   Q   H   Y   G   S   S   F   T   F   G   P   G   T
      GTG TAT TAC TGT CAG CAT TAT GGT AGC TCA TTC ACT TTC GGC CCT GGG ACC

307   K   V   D   I   K
      AAA GTG GAT ATC AAA
```

Fig. 16B

Anti-CD73 7A11-1 VH

V segment: VH3 / 3-09
D segment: D3 / 3-10
J segment: JH4 / 4

```
      E   V   Q   L   V   E   S   G   G   G   L   V   Q   T   G   R   S
1     GAA GTG CAG CTG GTG GAG TCT GGG GGA GGC TTG GTA CAG ACT GGC AGG TCC
                                                            CDR1
      L   R   L   S   C   A   A   S   G   F   T   F   D   D   Y   A   M
52    CTG AGA CTC TCC TGT GCA GCC TCT GGA TTC ACC TTT GAT GAT TAT GCC ATG

H   W   V   R   Q   A   P   G   K   G   L   E   W   V   S   D   I
103   CAC TGG GTC CGG CAA GCT CCA GGG AAG GGC CTG GAG TGG GTC TCA GAT ATT
                                                                  CDR2
      S   W   N   S   D   I   I   G   Y   A   D   S   V   K   G   R   F
154   AGT TGG AAT AGT GAT ATT ATA GGC TAT GCG GAC TCT GTG AAG GGC CGA TTC

T   I   S   R   D   N   A   K   N   S   L   Y   L   Q   M   N   S
205   ACC ATC TCT AGA GAC AAC GCC AAG AAC TCC CTG TAT CTG CAA ATG AAC AGT

L   R   A   E   D   T   A   L   Y   Y   C   A   K   G   D   I   Y   G
256   CTG AGA GCT GAG GAC ACG GCC TTG TAT TAC TGT GCA AAA GGA GAT ATT TAT GGT
                                                            CDR3

S   G   S   S   F   F   D   Y   W   G   Q   G   I   L   V   T   V
307   TCG GGG AGT TCT TTT TTT GAC TAC TGG GGC CAG GGA ATC CTG GTC ACC GTC

S   S
358   TCC TCA
```

*Fig. 17A*

Anti-CD73 7A11-1 VK

V segment:    VK1 / L15
J segment:    JK5 / 5

```
  1  D   I   Q   M   T   Q   S   P   S   S   L   S   A   S   V   G   D
     GAC ATC CAG ATG ACC CAG TCT CCA TCC TCA CTG TCT GCA TCT GTA GGA GAC
                                             CDR1
 52  R   V   T   I   T   C   R   A   S   Q   Y   I   S   S   W   L   A
     AGA GTC ACC ATC ACT TGT CGG GCG AGT CAG TAT ATT AGC AGC TGG TTA GCC
                                                                    CDR2
103  W   Y   Q   Q   K   P   E   K   A   P   K   S   L   I   Y   A   A
     TGG TAT CAG CAG AAA CCA GAG AAA GCC CCT AAG TCC CTG ATC TAT GCT GCA
154  S   S   L   Q   S   G   V   P   S   R   F   S   G   S   G   S   G
     TCC AGT TTG CAA AGT GGG GTC CCA TCA AGG TTC AGC GGC AGT GGA TCT GGG
205  T   D   F   T   L   T   I   S   S   L   Q   P   E   D   F   A   T
     ACA GAT TTC ACT CTC ACC ATC AGC AGC CTG CAG CCT GAA GAT TTT GCA ACT
                         CDR3
256  Y   Y   C   Q   Q   Y   H   S   Y   P   P   T   F   G   Q   G   T
     TAT TAC TGC CAA CAG TAT CAT AGT TAC CCT CCC ACC TTC GGC CAA GGG ACA
307  R   L   E   I   K
     CGA CTG GAG ATT AAA
```

Fig. 17B

QVQLVESGGGVVQPGRSLRLSCAASGFTFSNYGMHWVRQAPGKGLEWVAVILYDGSNKYYPDSVKGRFTISR
DNSKNTLYLQMNSLRAEDTAVYYCARGGSSWYPDSFDIWGQGTMVTVSSASTKGPSVFPLAPCSRSTSESTA
ALGCLVKDYFPEPVTVSWNSGALTSGVHTFPAVLQSSGLYSLSSVVTVPSSNFGTQTYTCNVDHKPSNTKVDK
TVERKSCVECPPCPAPPVAGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPSSIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVMHEALHN
HYTQKSLSLSPG

No underline: VH
CDR1, 2 and 3
CH1
Hinge
CH2
CH3

*Fig. 18*

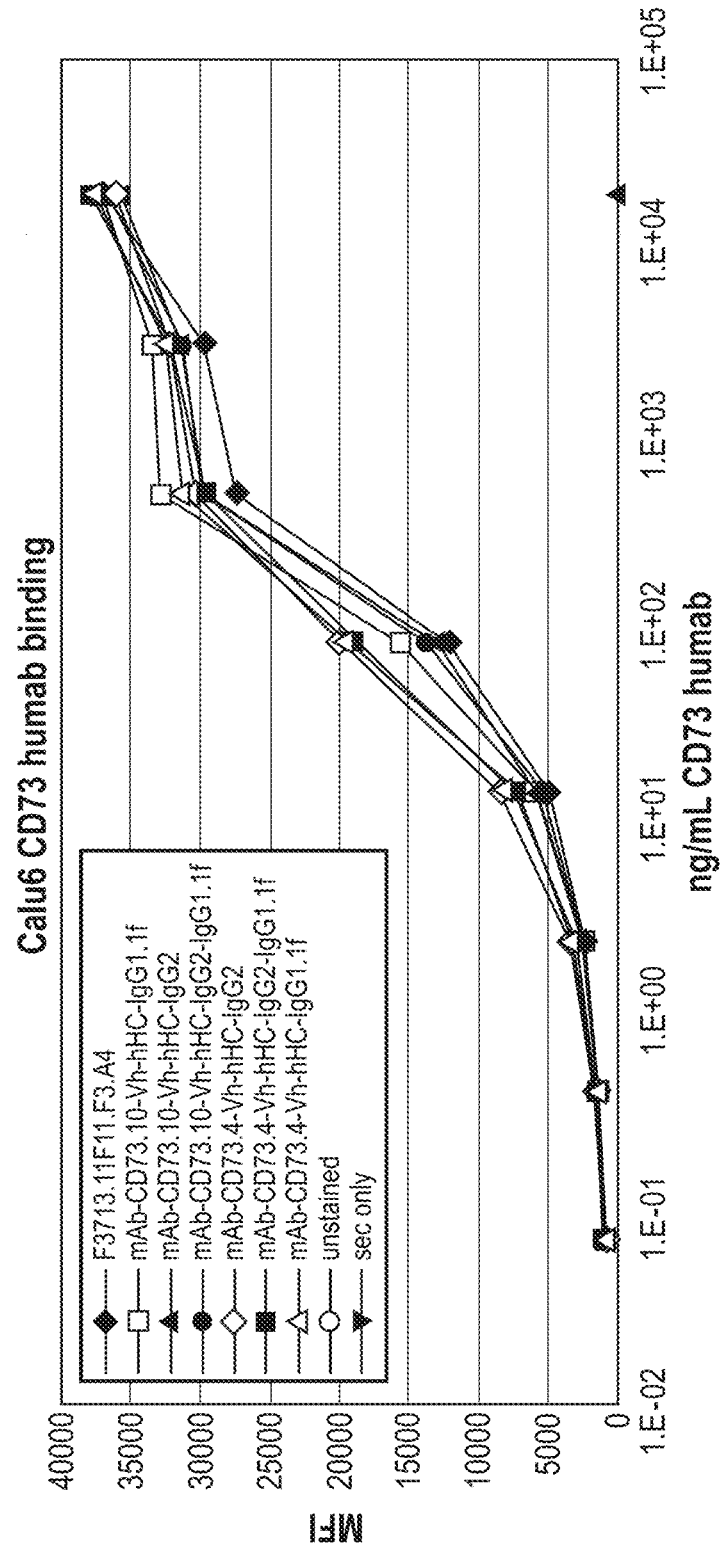
Fig. 20A1

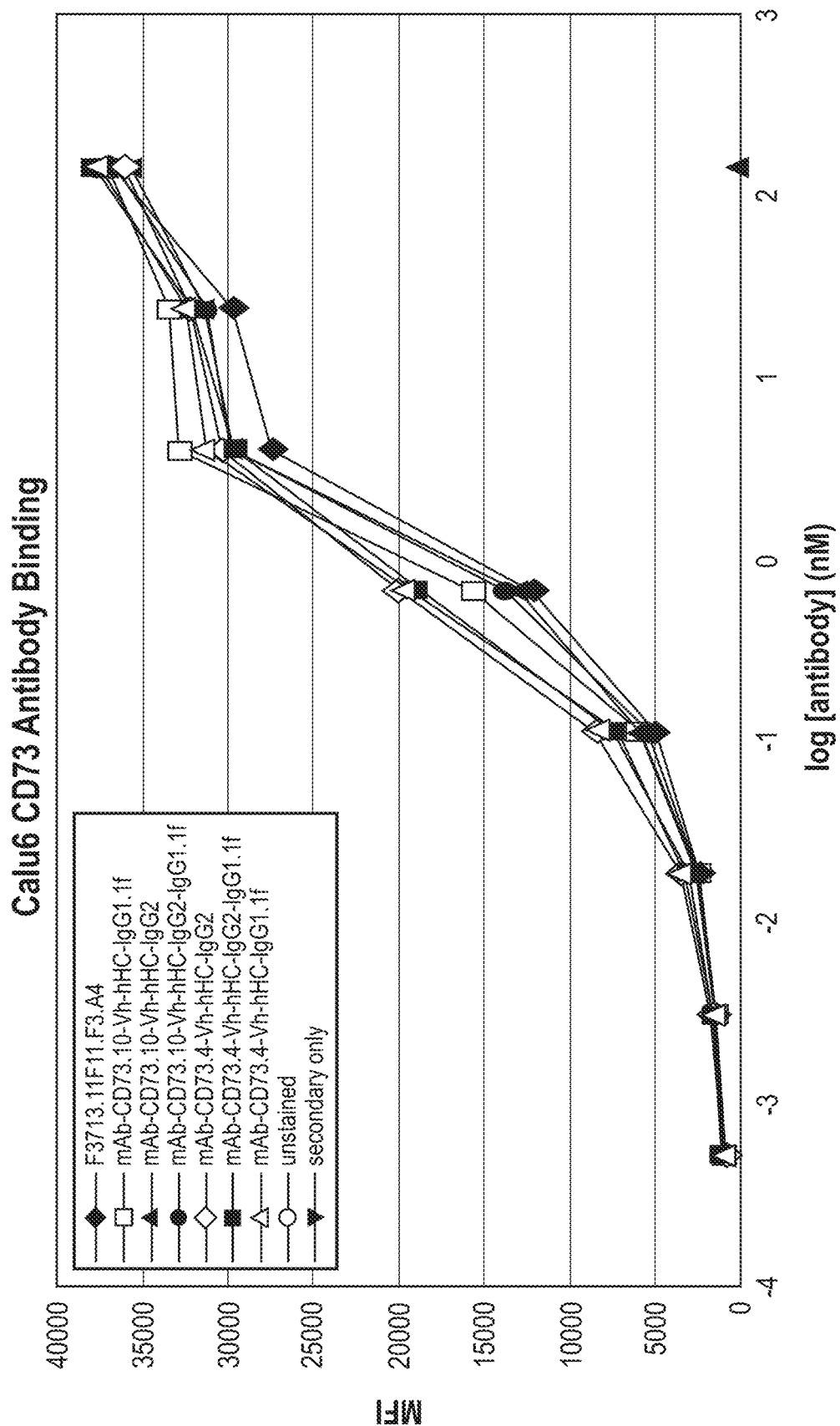
Fig. 20A2

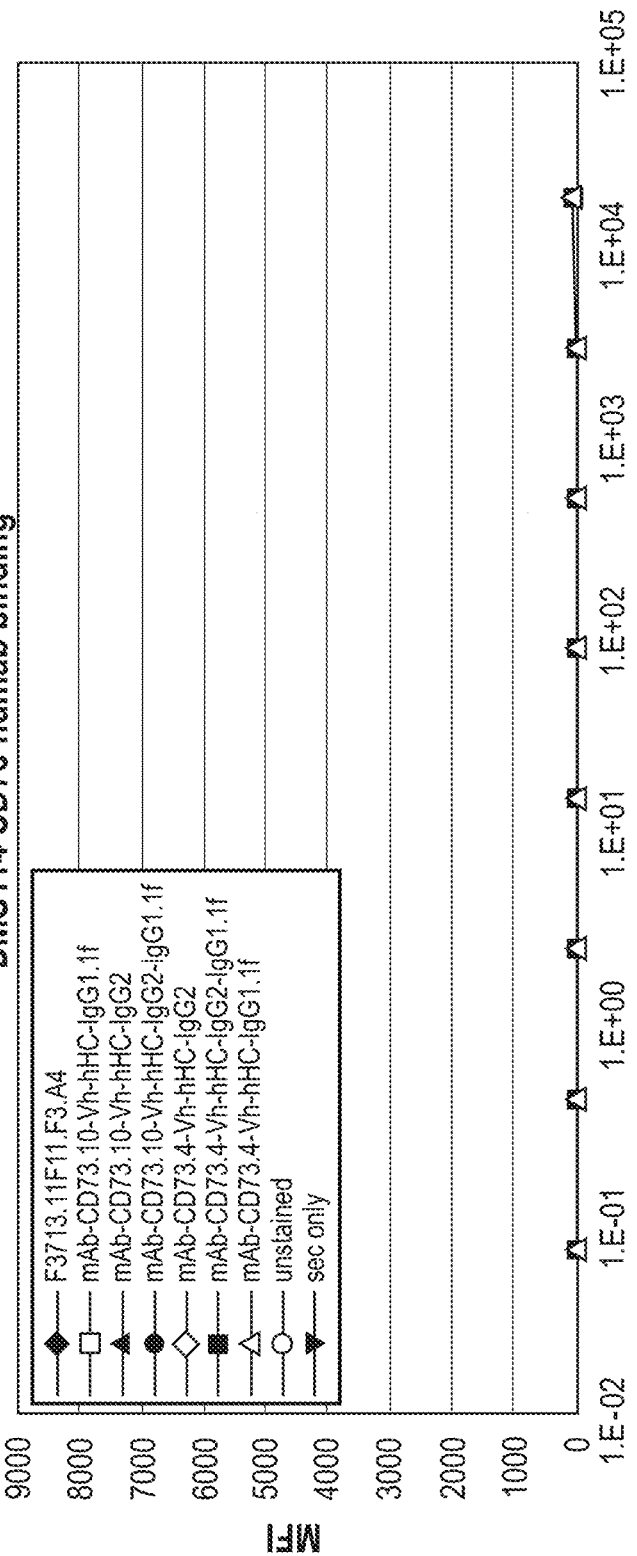

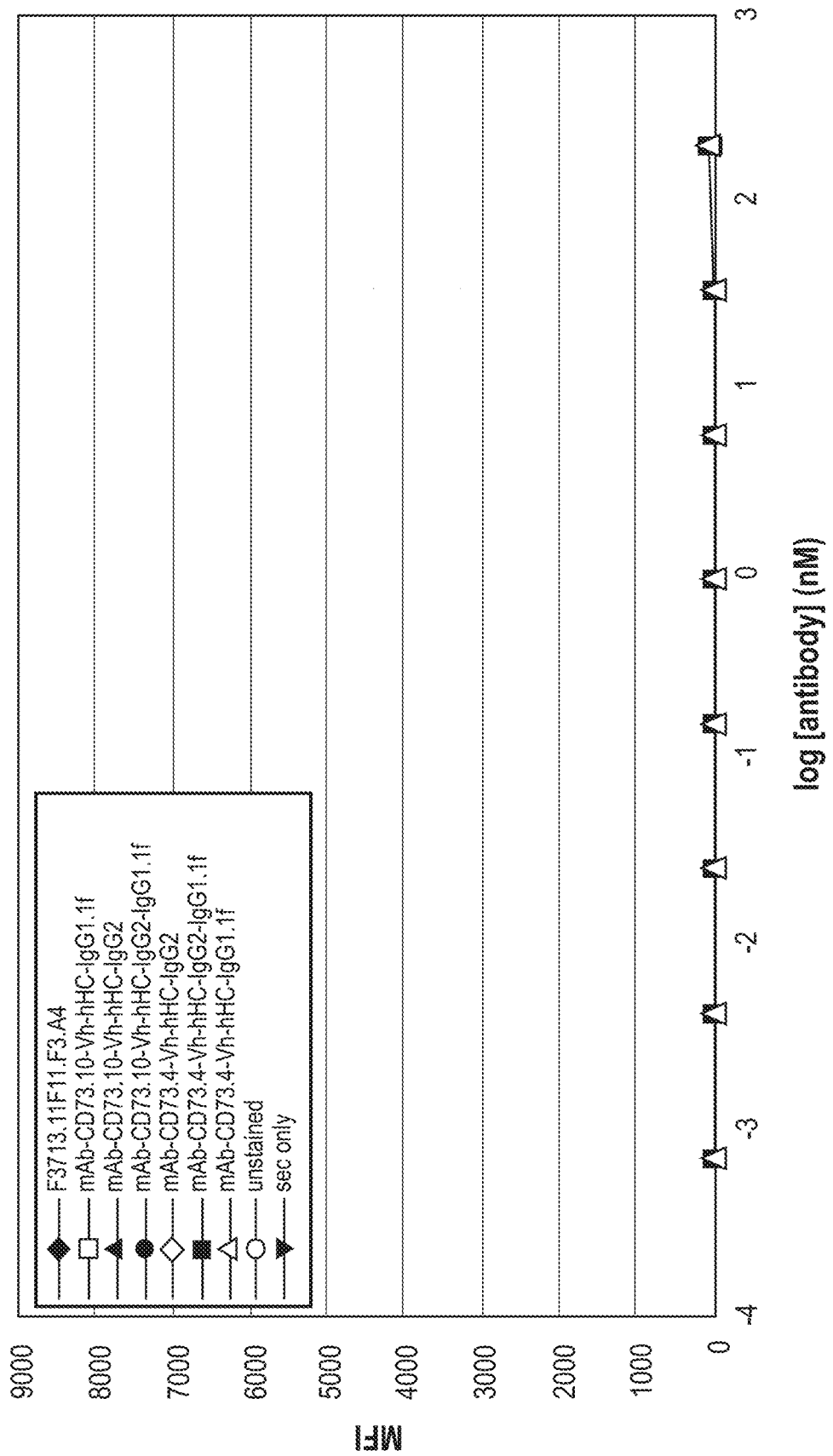
Fig. 20B2

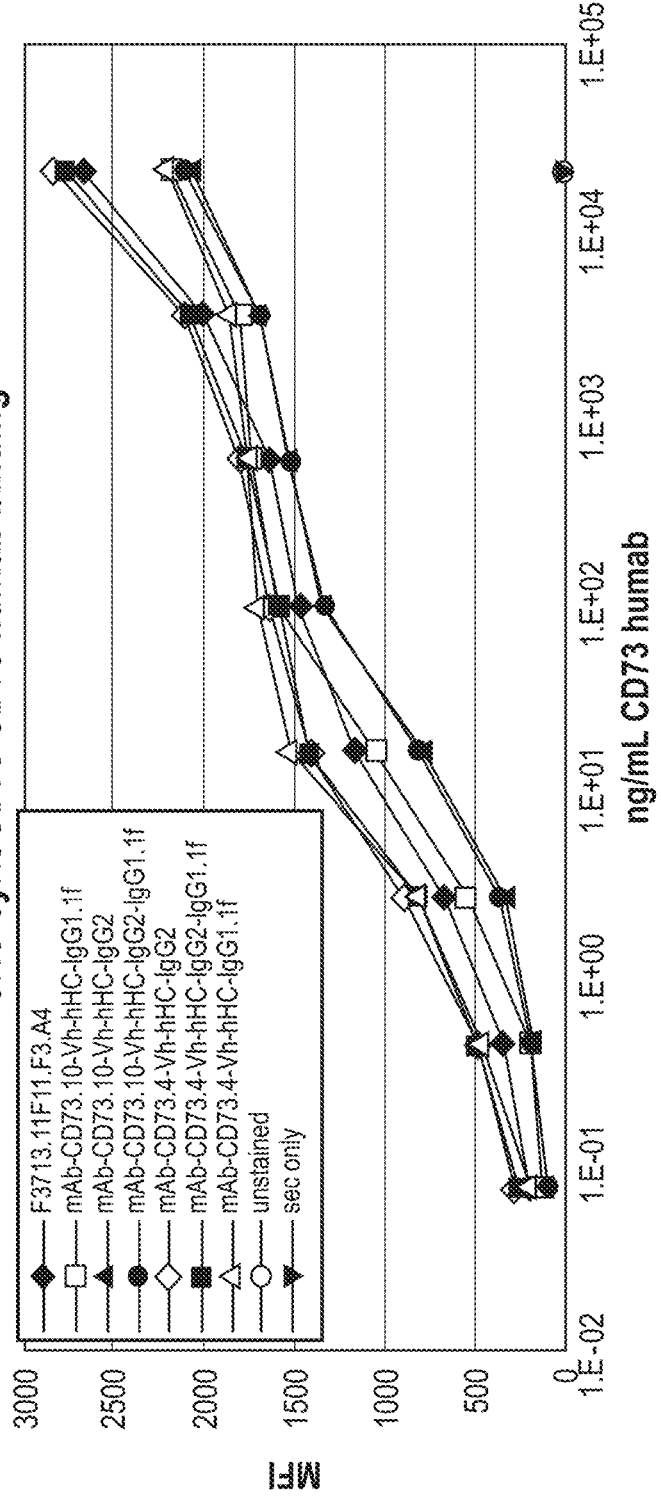
Fig. 20C1

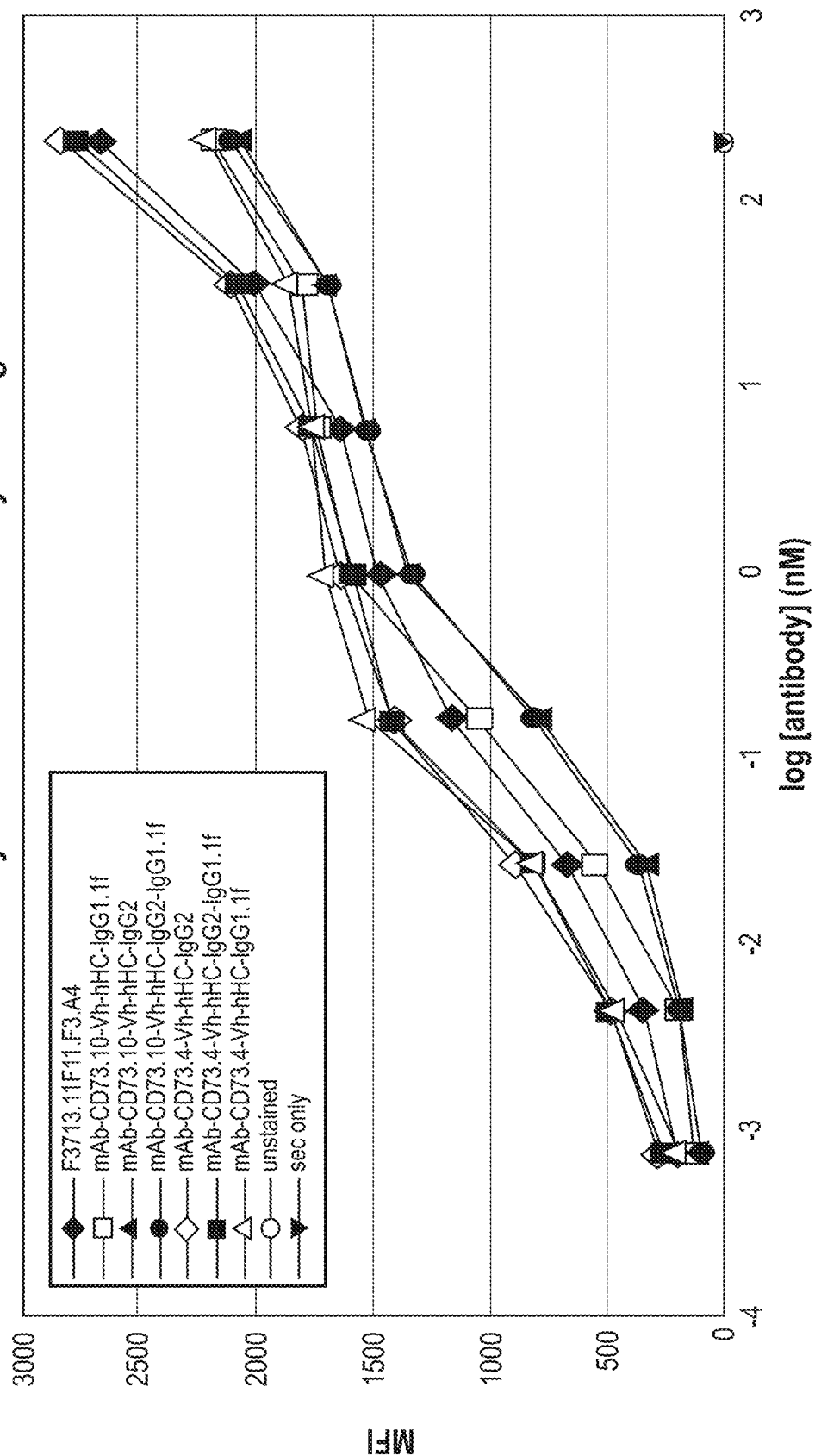

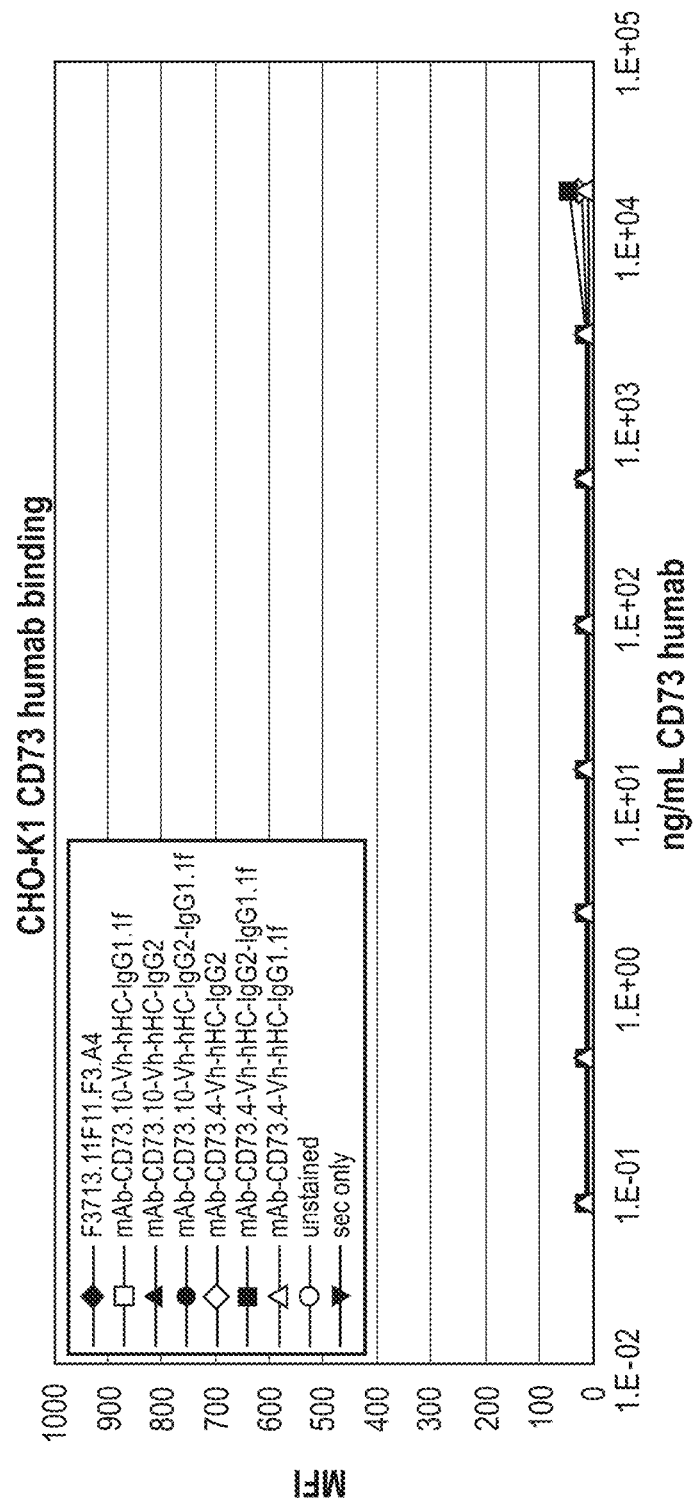
Fig. 20D1

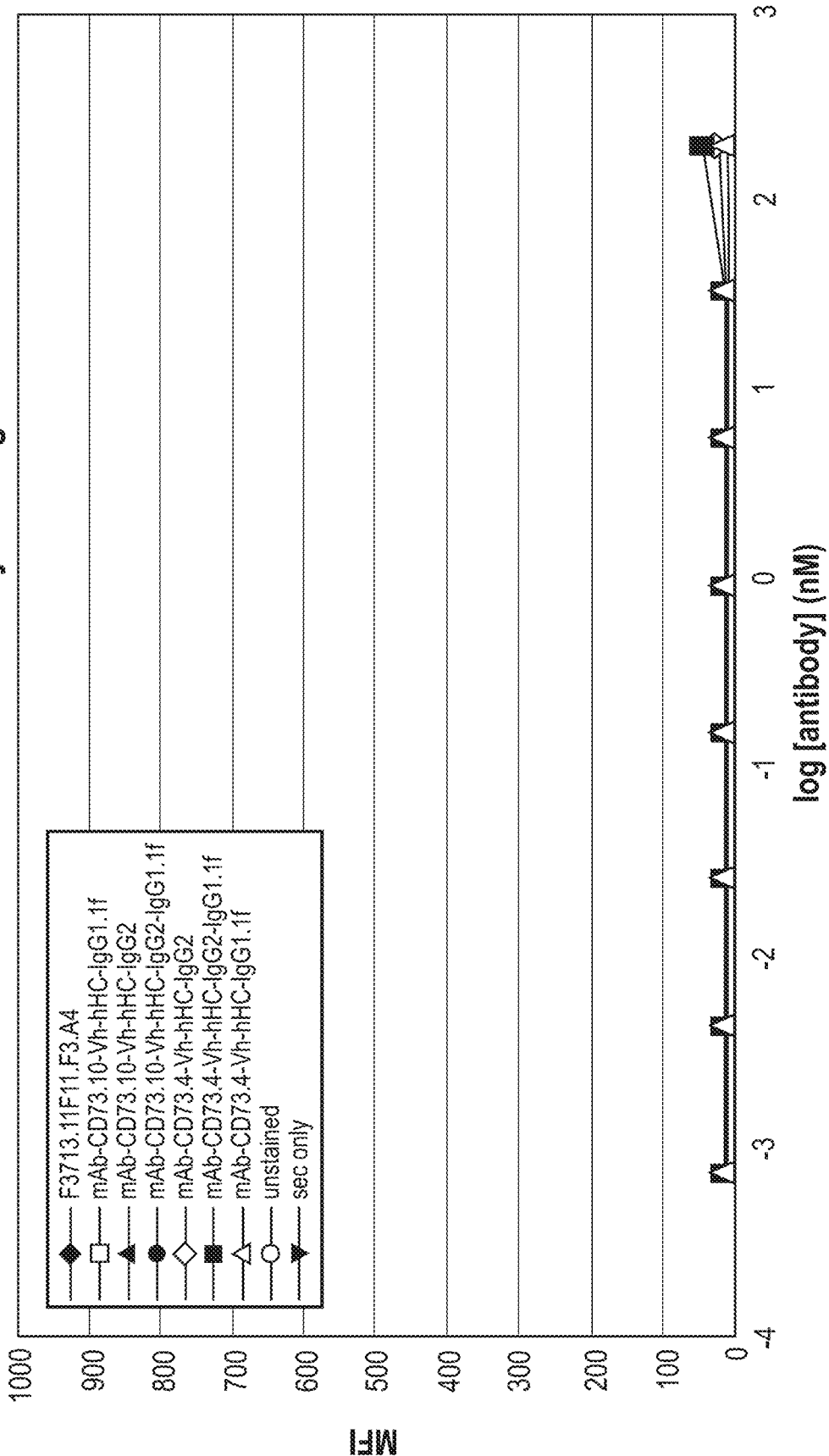
Fig. 20D2

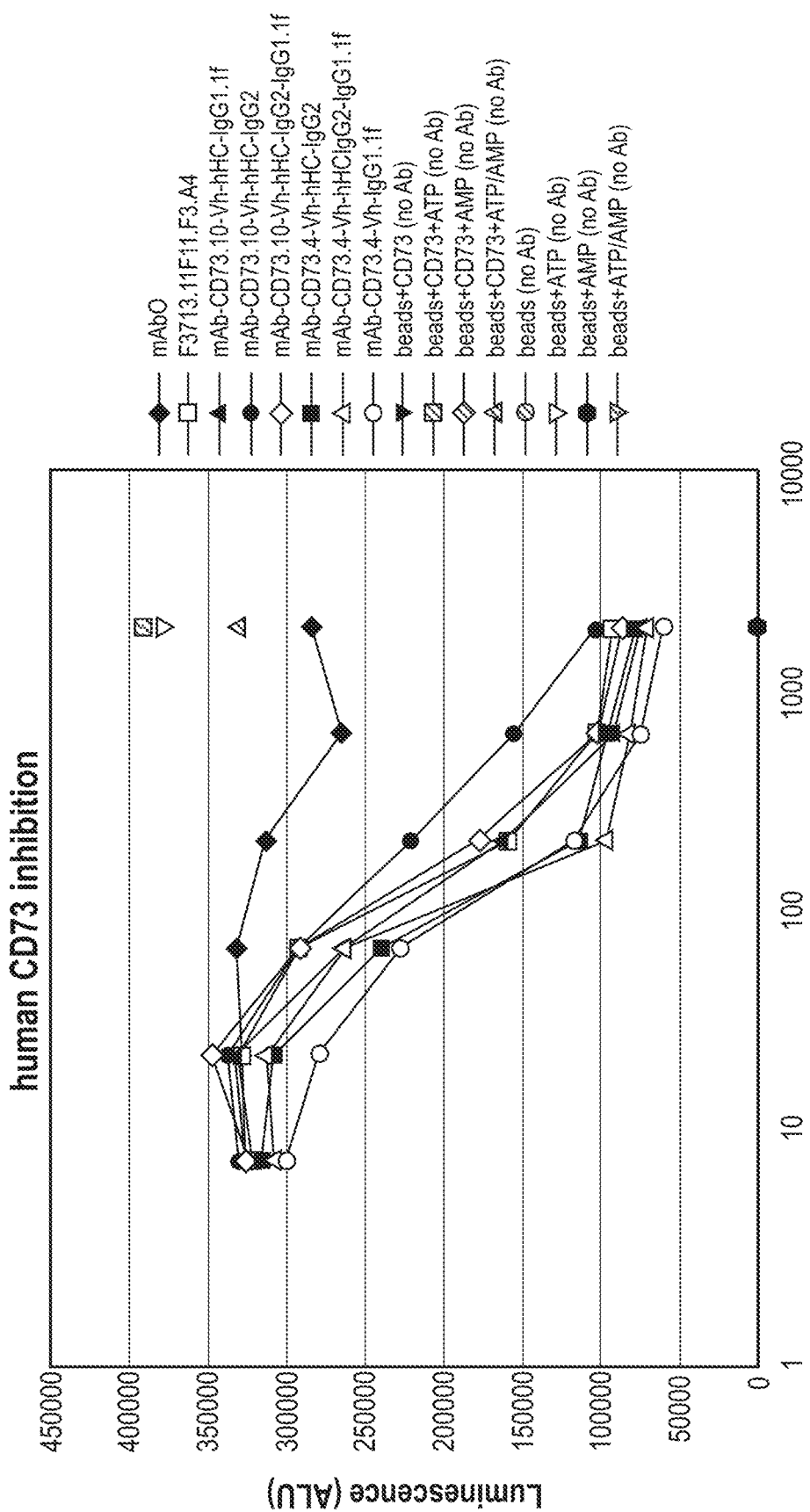
Fig. 21A1

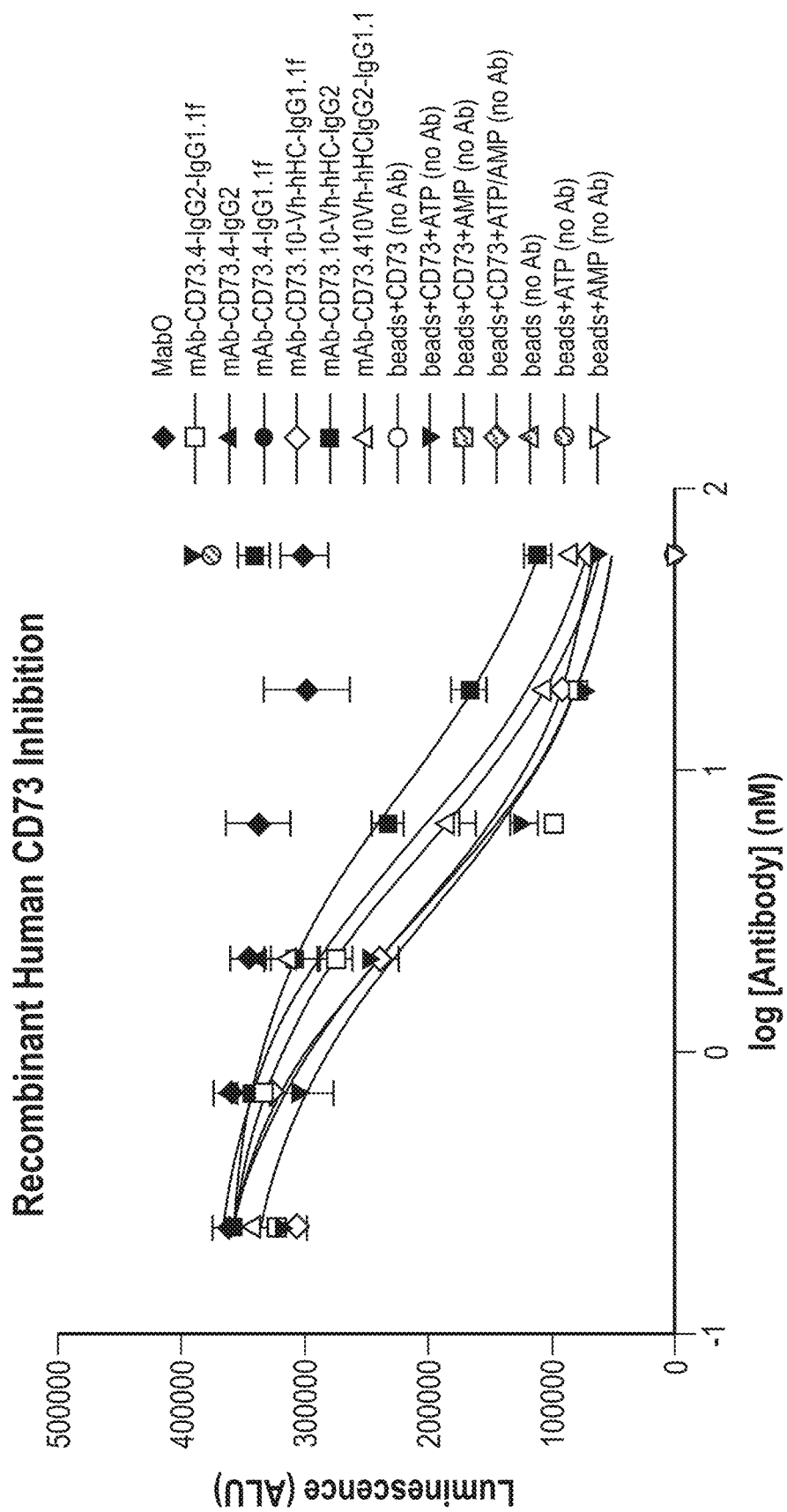
Fig. 21A2

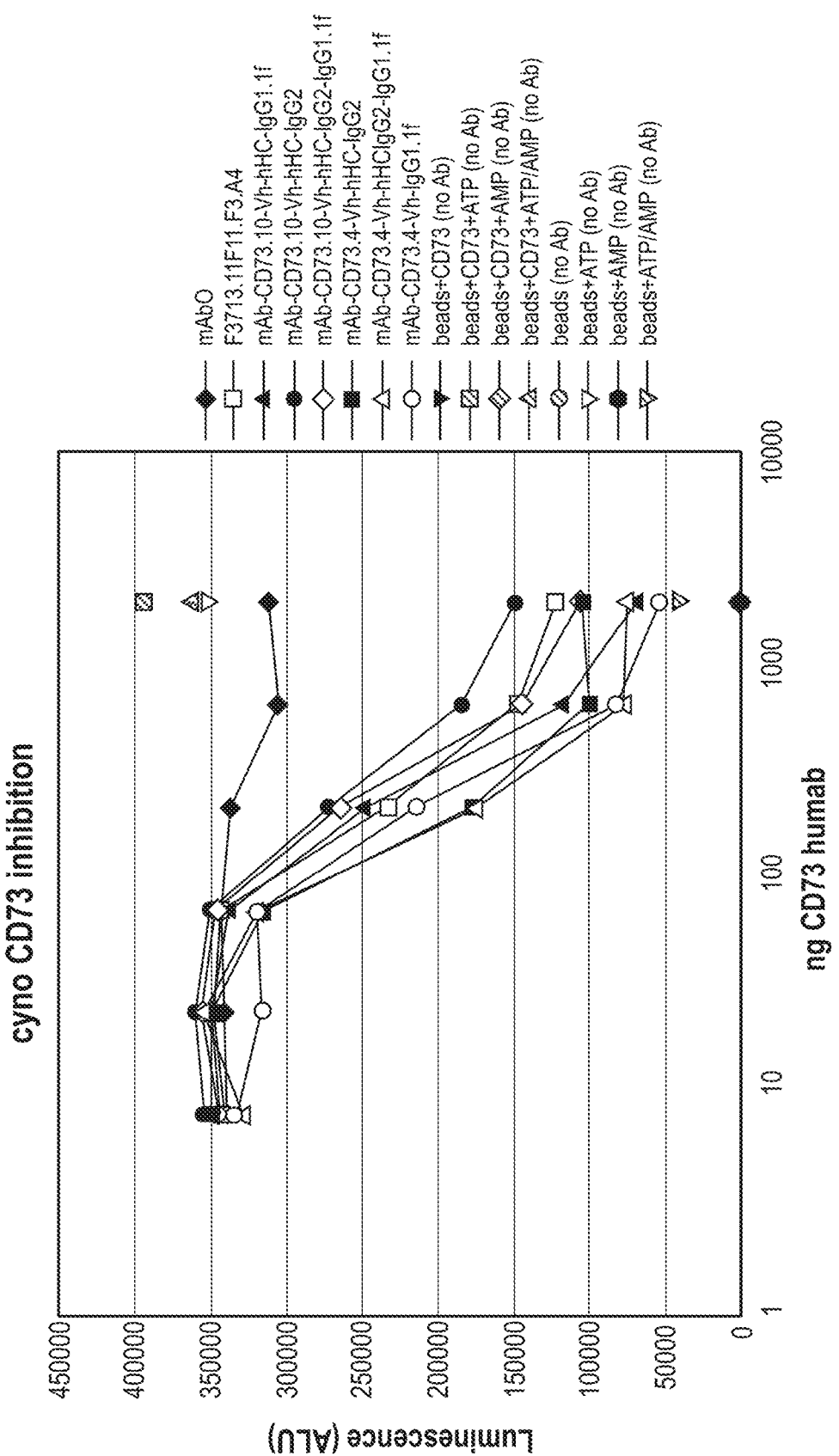
Fig. 21B1

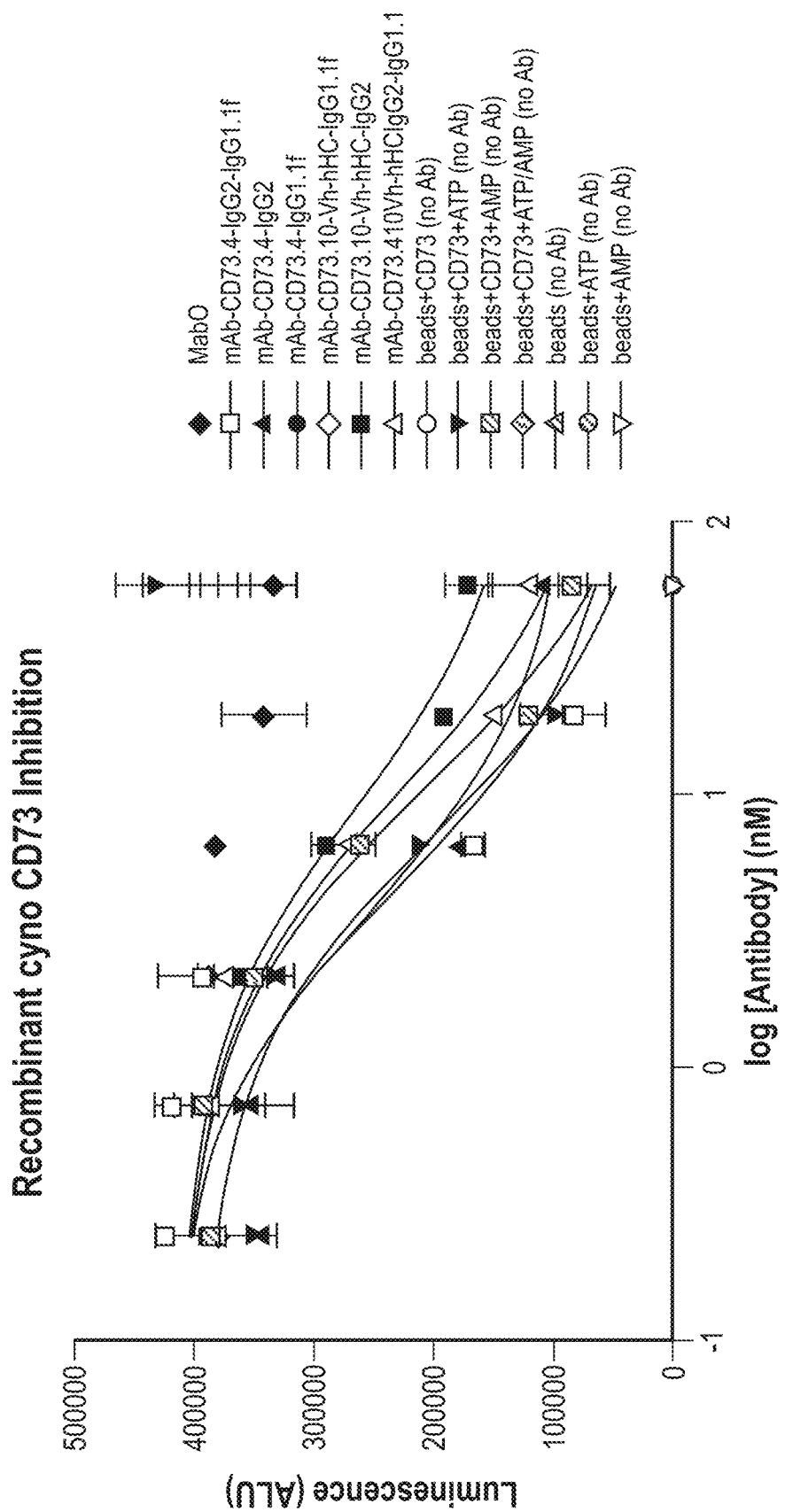
Fig. 21B2

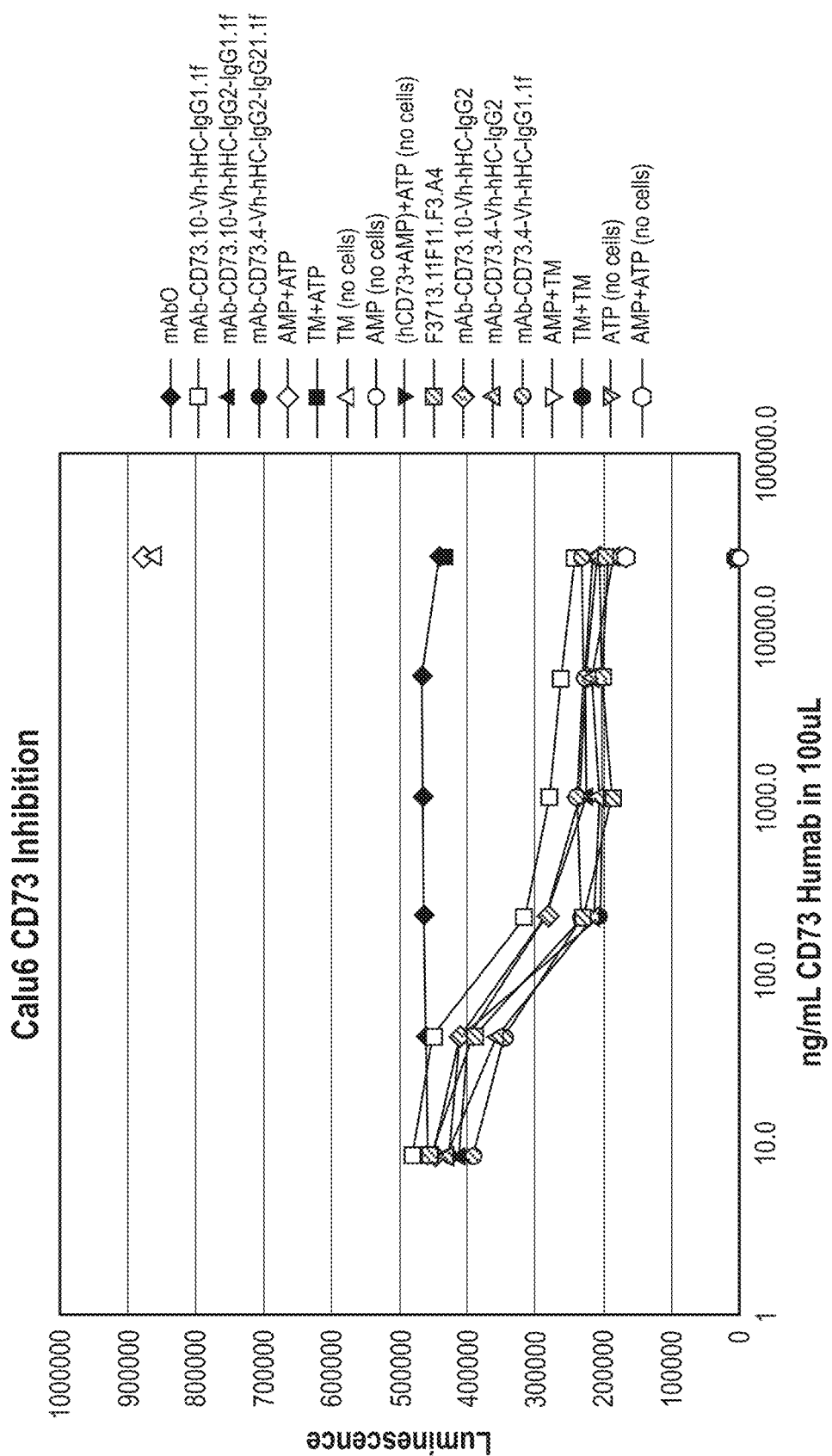
Fig. 22A1

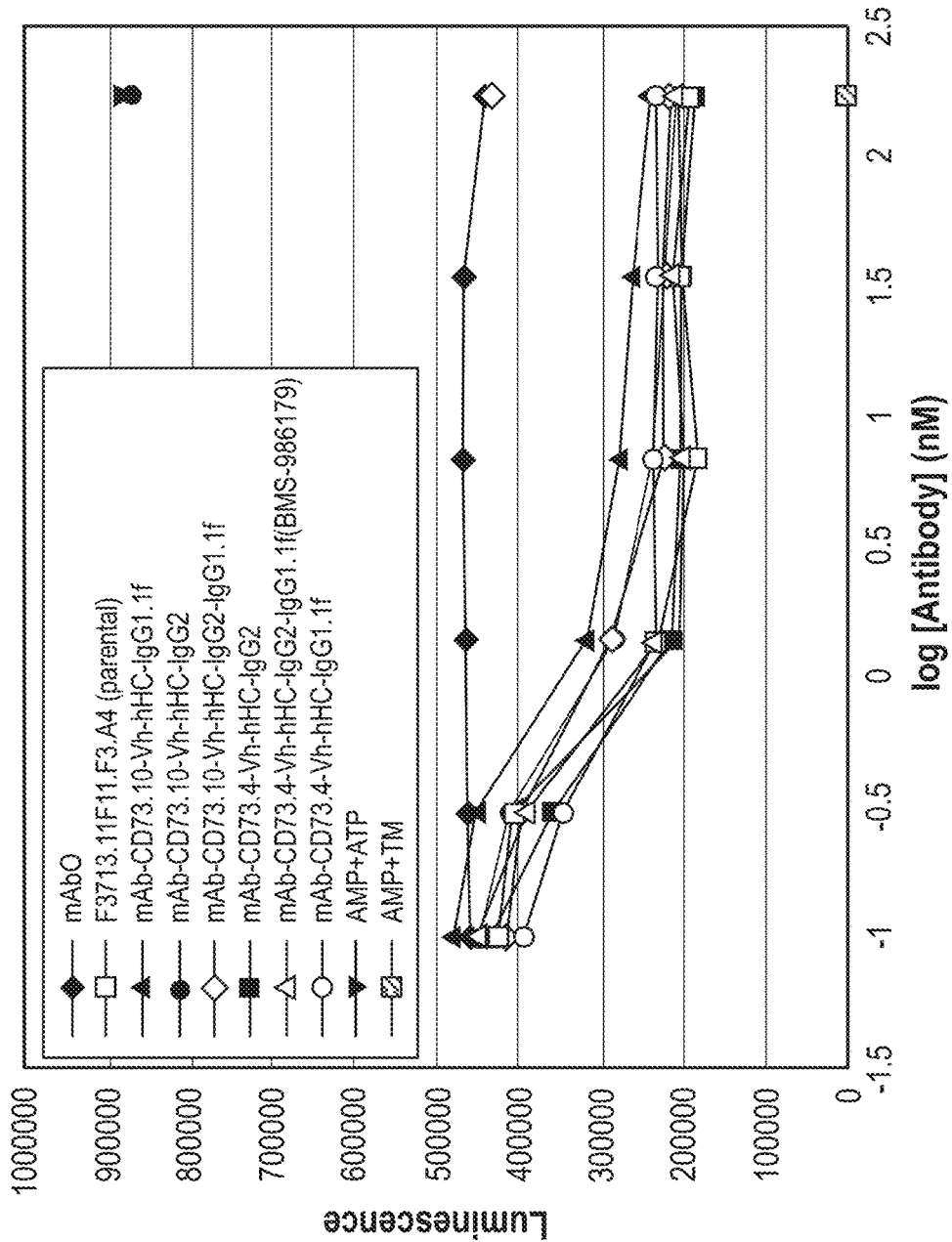
Fig. 22A2

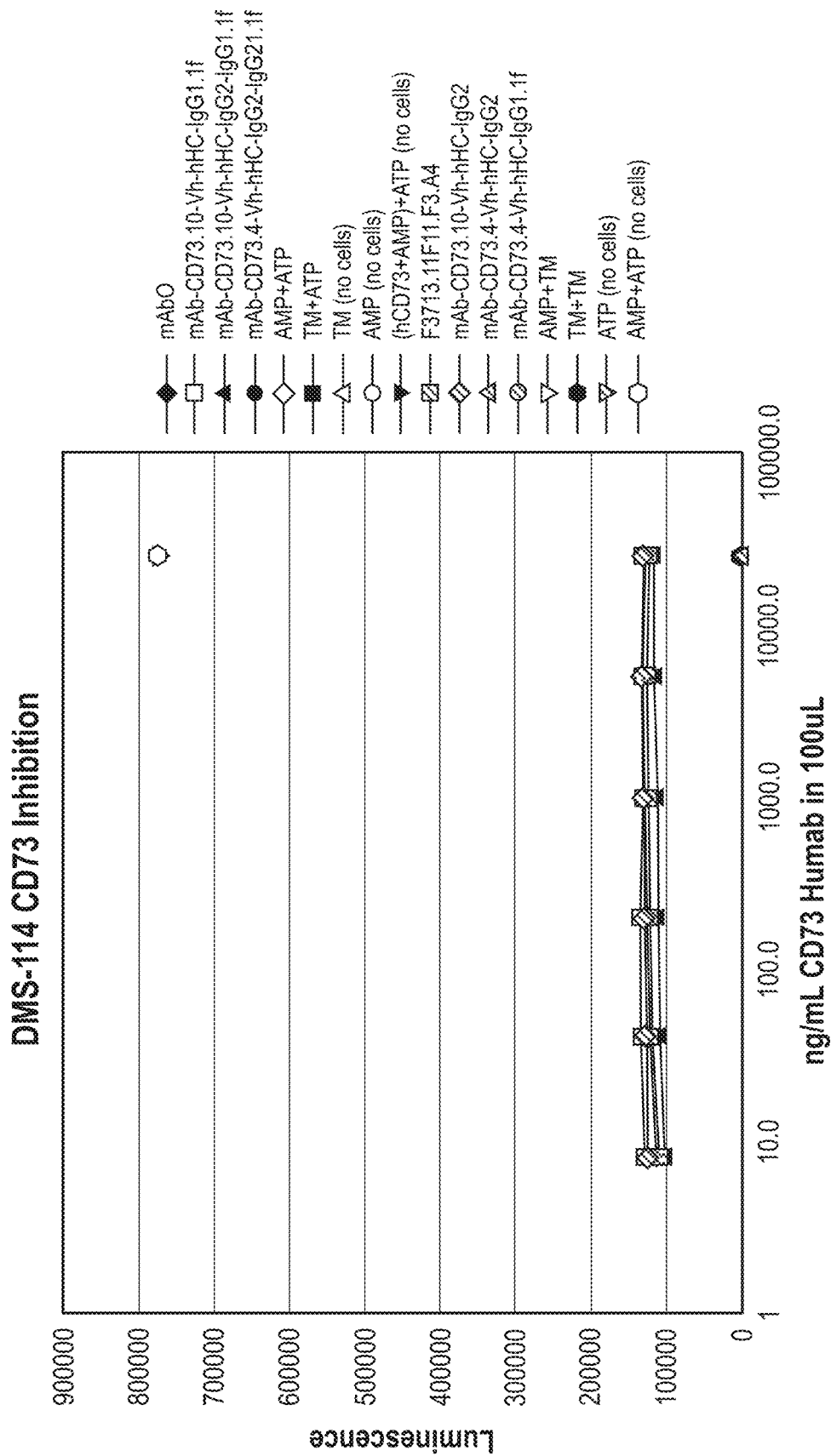
Fig. 22B1

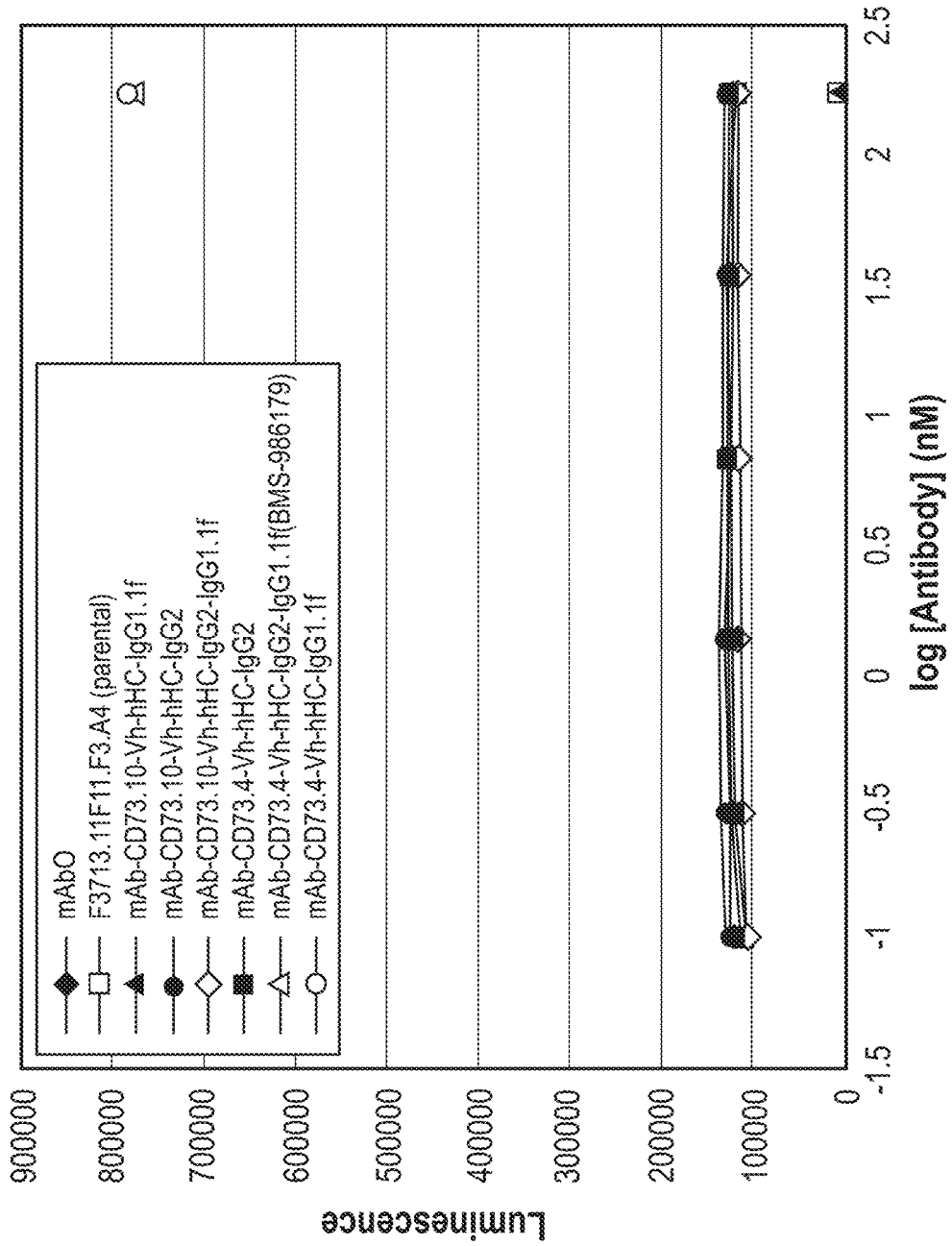
Fig. 22B2

| Clone ID | cAMP Assay (Calu-6+HEK/A2AR) | | | Internalization (Calu-6) | | |
|---|---|---|---|---|---|---|
| | EC50, nM | YMAX | Graph | EC50, nM | YMAX | Graph |
| 11F11 | 0.64 | 95 | MDA-001271.01-001 | 0.26 | 100 | MDA-001271.01-001 |
| 11F11 Fab | Inactive | | CTL-000001.01-001 | Inactive | | CTL-000001.01-001 |
| 11F11 Fab'2 | 0.49 | 87 | CTL-000001.01-001 | 0.10 | 110 | CTL-000001.01-001 |
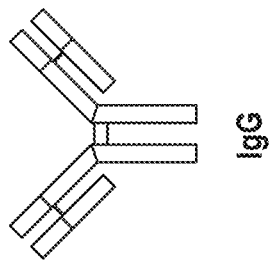
IgG
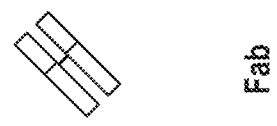
Fab
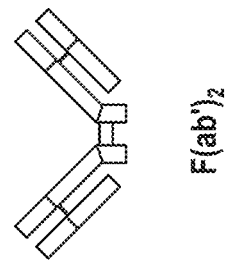
F(ab')₂
Fig. 22C

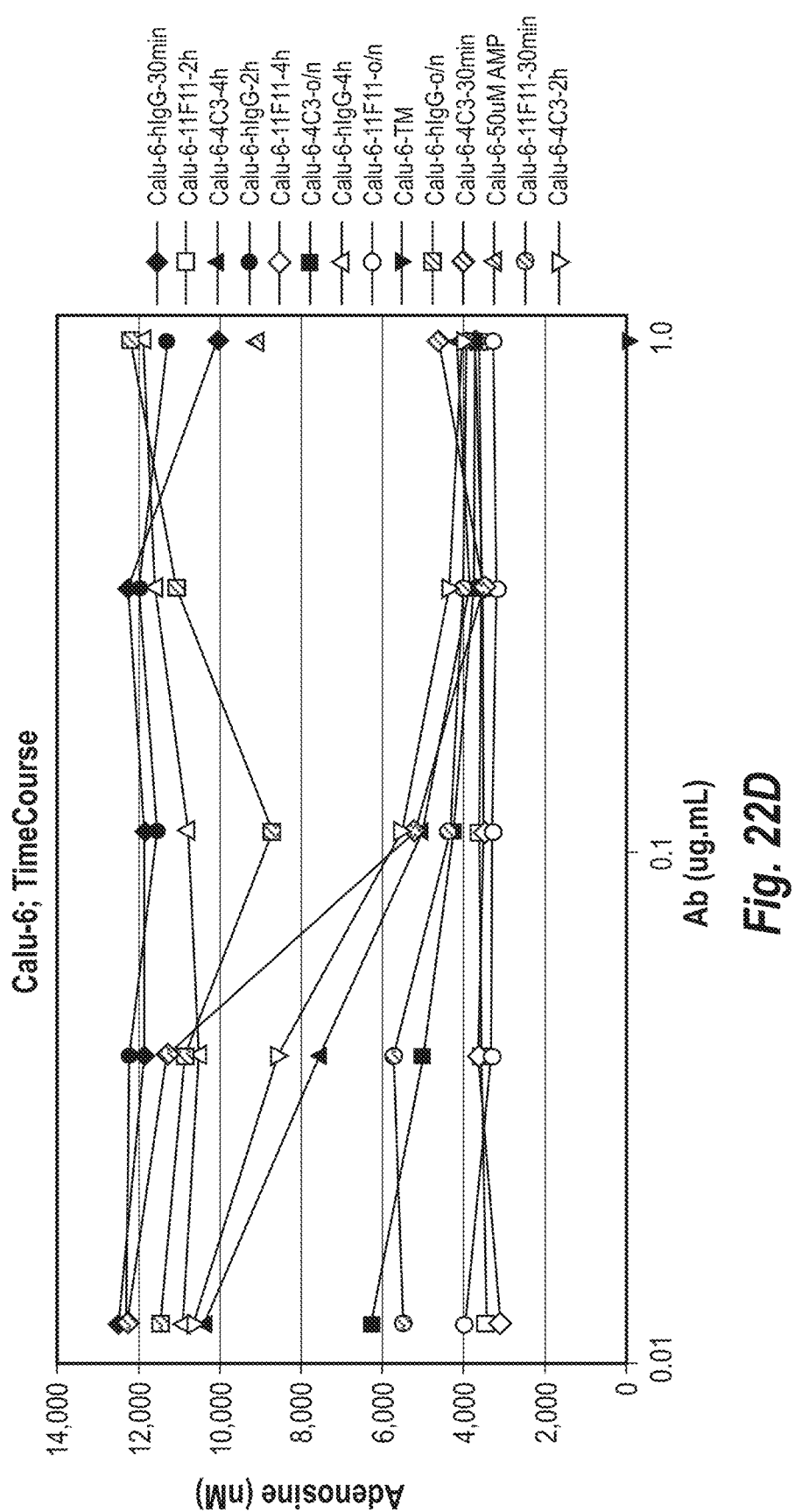

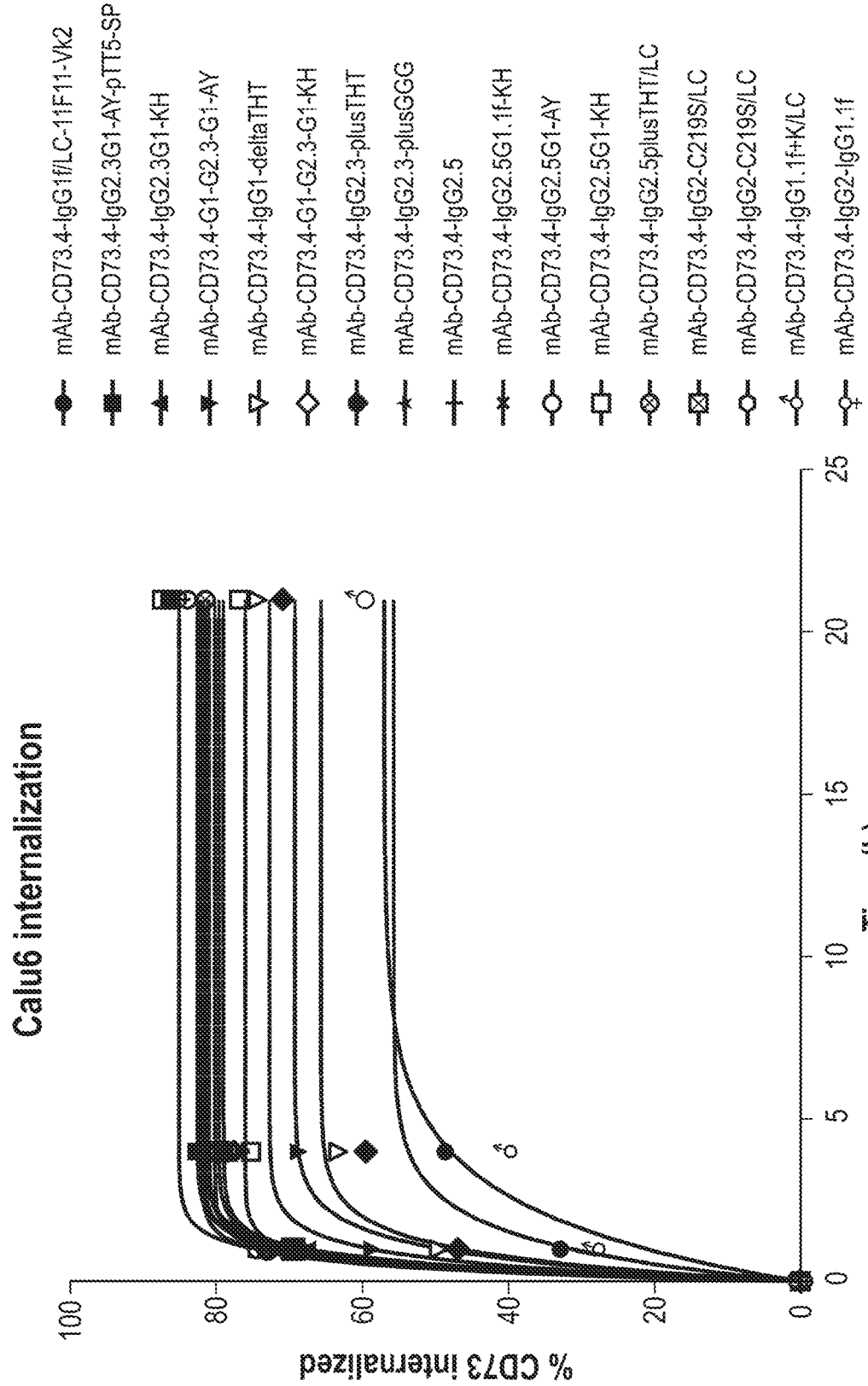

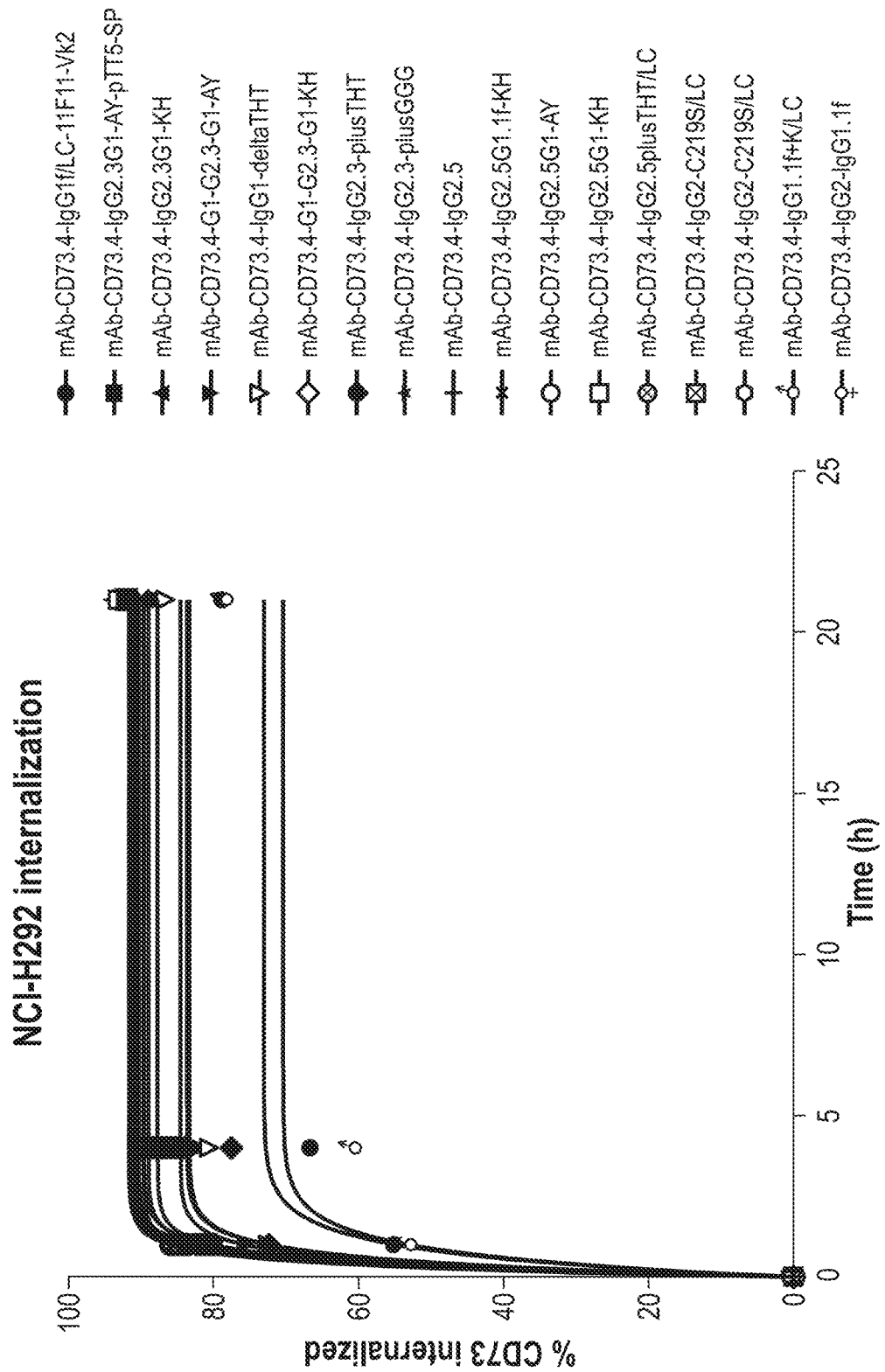

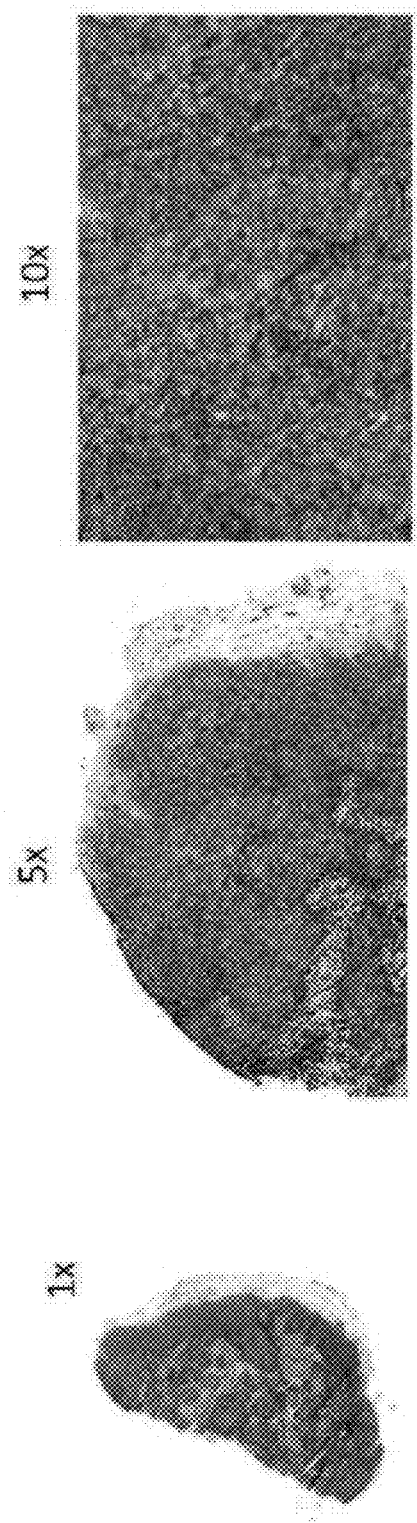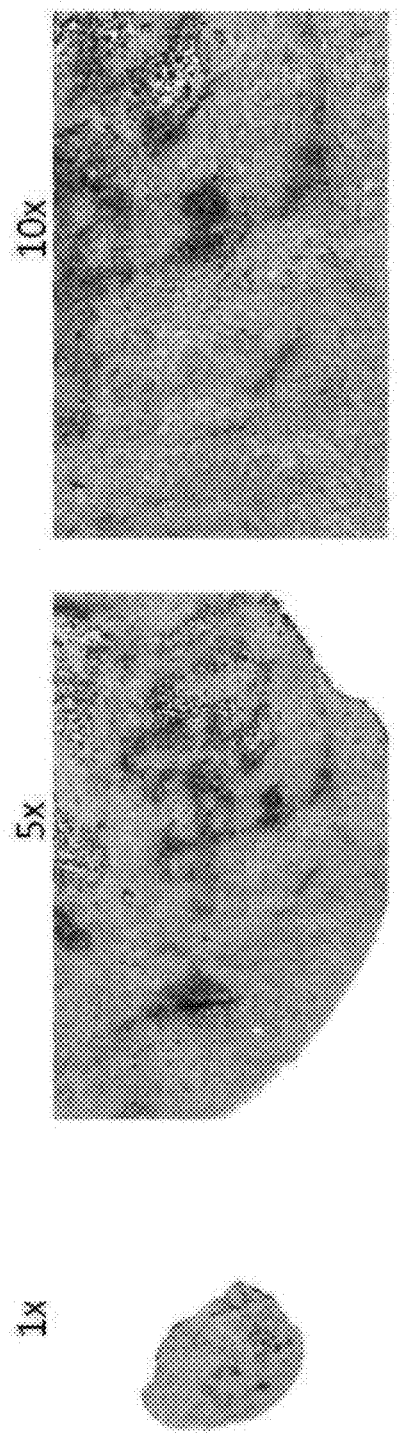
Fig. 24A-B

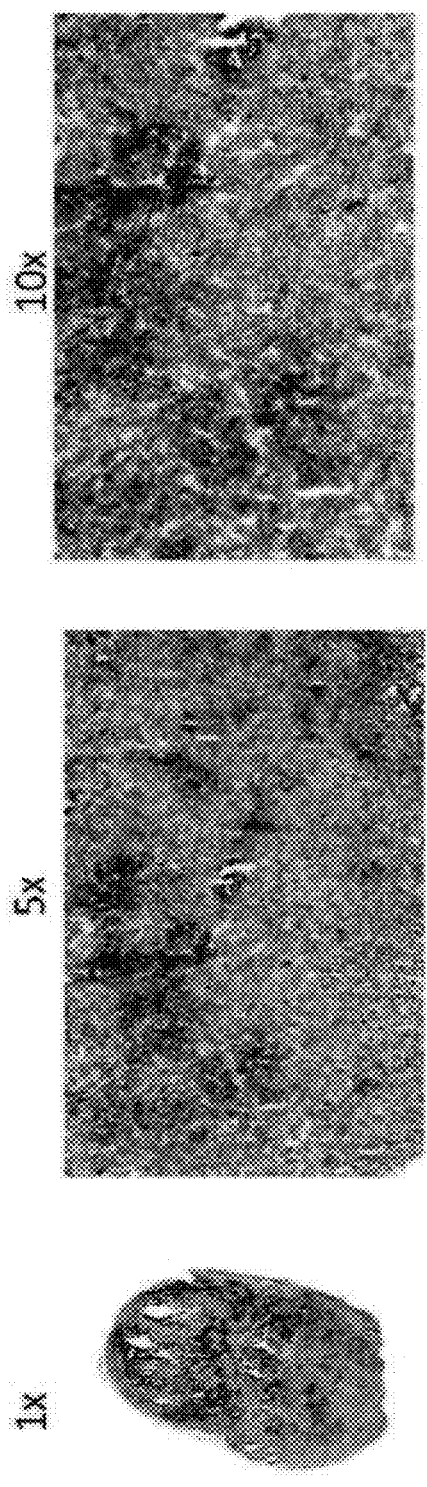
Fig. 24C-D

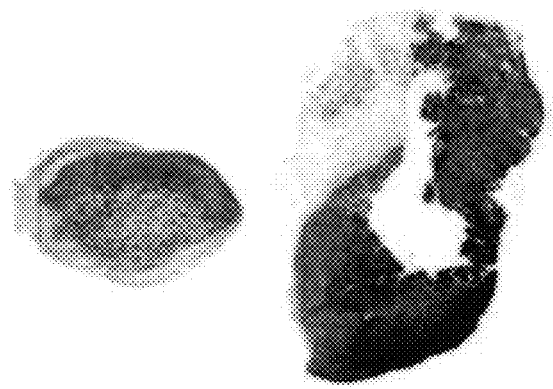
Fig. 25A

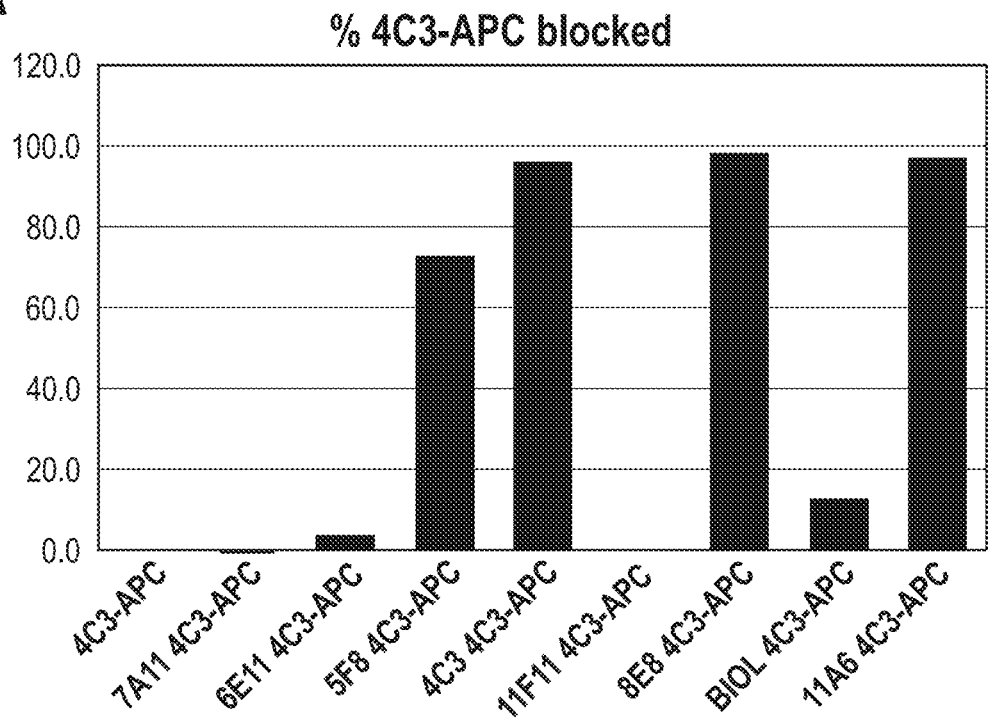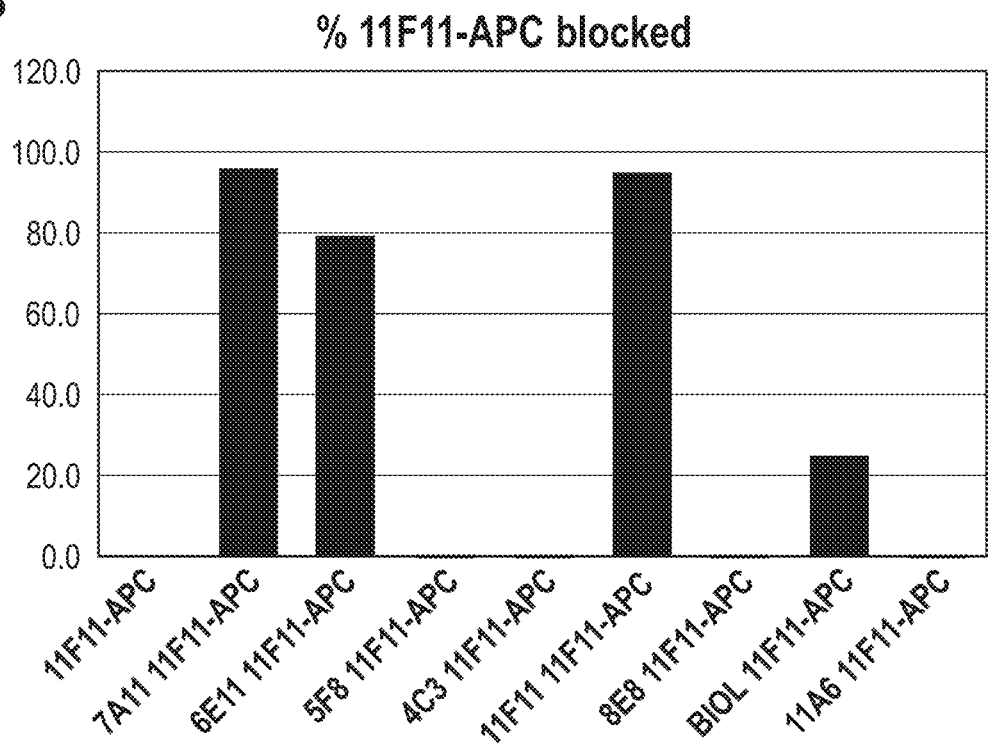
Fig. 26A-B

Composite structure of two CD73(NDT)/11F11 complexes superimposed on CD73 dimer (PDP Entry 4H1S)

Surface rendering of CD73 (grey) with interacting residues of 11F11 (magenta). Buried surface shown in yellow and contact surface in orange Table 25: SEC-MALS data for CD73/mAb complexes

| Target | mAb | Molar ratio | [target] (uM) | [mAb] (uM) | UV elution time (min) Peak 1 | Peak 2 | Peak 3 | Peak 4 | SEC UV integration by % Peak 1 | Peak 2 | Peak 3 | Peak 4 | MW (kDa) Peak 1 | Peak 2 | Peak 3 | Peak 4 |
|---|---|---|---|---|---|---|---|---|---|---|---|---|---|---|---|---|
|  | CD73.10-IgG1.1f | 0:1 |  | 4 | ~2.0 | ~14.0 | ~17.3 |  | 0.3 | 0.3 | 99.4 |  | n/a | 62 | 140 |  |
|  | CD73.10-IgG2-C219S | 0:1 |  | 4 | ~2.0 | ~17.5 |  |  | 0.1 | 99.5 |  |  | 73 | 150 |  |  |
|  | CD73.3-IgG1.1f | 0:1 |  | 8 | ~16.3 |  |  |  | 100.0 |  |  |  | 150 |  |  |  |
|  | 11F11-Fab | 0:1 |  | 8 | ~2.0 | ~17.7 | ~20.2 |  | 0.8 | 0.6 | 98.7 |  | n/a | 19 | 47 |  |
| hCD73-his |  | 1:0 | 4 |  | ~17.1 | ~18.4 |  |  | 2.8 | 97.2 |  |  | 280 | 120 |  |  |
| N-hCD73-his |  | 1:0 | 8 |  | ~19.3 |  |  |  | 100.0 |  |  |  | 38 |  |  |  |
| hCD73-his | CD73.10-IgG1.1f | 1:1 | 4 | 4 | ~11.7 | ~12.7 | ~16.9 |  | 34.2 | 67.2 | 3.0 |  | 1100 | 540 | 180 |  |
| N-hCD73-his | CD73.10-IgG2-C219S | 1:1 | 4 | 4 | ~10.3 | ~11.1 |  |  | 6.4 | 93.3 |  |  | 110000 | 3400 |  |  |
| hCD73-his | CD73.3-IgG1.1f | 1:1 | 4 | 4 | ~12.0 | ~13.0 | ~14.8 |  | 17.5 | 78.3 | 4.0 |  | 960 | 530 | 260 |  |
| hCD73-his | 11F11-Fab | 1:2 | 4 | 8 | ~12.6 | ~14.7 | ~16.8 | ~20.1 | 0.9 | 90.7 | 0.8 | 7.7 | 300 | 310 | 85 | 40 |
| N-hCD73-his | CD73.10-IgG1.1f | 2:1 | 8 | 4 | ~14.6 | ~17.1 |  |  | 86.5 | 13.5 |  |  | 210 | 140 |  |  |
| N-hCD73-his | CD73.10-IgG2-C219S | 2:1 | 8 | 4 | ~14.7 | ~17.3 |  |  | 87.1 | 12.9 |  |  | 210 | 150 |  |  |
| N-hCD73-his | CD73.3-IgG1.1f | 2:1 | 8 | 4 | ~15.3 | ~16.2 | ~19.3 |  | 6.4 | 68.7 | 24.9 |  | 170 | 160 | 42 |  |
| N-hCD73-his | 11F11-Fab | 2:1 | 8 | 8 | ~17.4 | ~20.0 |  |  | 95.3 | 4.7 |  |  | 84 | 44 |  |  |
| hCD73 |  | 1:0 | 2.5 |  | ~16.9 | ~18.2 |  |  | 100.0 |  |  |  | 120 |  |  |  |
| hCD73 | CD73.4-hybrid | 1:0.25 | 2.5 | 0.625 | ~11.8 | ~13.4 | ~17.1 |  | 42.0 | 21.6 | 36.4 |  | 1200 | 520 | 120 |  |
| hCD73 | CD73.4-hybrid | 1:0.5 | 2.5 | 1.25 | ~11.7 | ~13.4 | ~17.1 |  | 71.9 | 15.8 | 13.4 |  | 1900 | 540 | 130 |  |
| hCD73 | CD73.4-hybrid | 1:1 | 2.5 | 2.5 | ~11.5 | ~13.4 | ~17.1 |  | 95.3 | 1.9 | 2.8 |  | 3300 | 1000 | 530 |  |
| hCD73 | CD73.4-hybrid | 1:2 | 2.5 | 5 | ~11.7 | ~13.4 | ~15.3 | ~17.0 | 52.5 | 17.7 | 0.6 | 29.3 | 1700 | 500 | 220 | 140 |
| hCD73 | CD73.4-hybrid | 1:4 | 2.5 | 10 | ~11.7 | ~13.4 | ~15.3 | ~17.0 | 24.1 | 16.2 | 1.2 | 58.6 | 1300 | 500 | 200 | 140 |
| hCD73 | CD73.4-hybrid | 1:0 | 2.5 | 0 | ~16.9 | ~18.2 |  |  | 97.6 | 2.4 |  |  | 120 | 73 |  |  |
| hCD73 | CD73.4-IgG1.1f | 1:0.25 | 2.5 | 0.625 | ~12.3 | ~13.1 | ~17.1 |  | 11.8 | 49.5 | 38.6 |  | 830 | 530 | 120 |  |
| hCD73 | CD73.4-IgG1.1f | 1:0.5 | 2.5 | 1.25 | ~12.3 | ~13.1 | ~17.1 |  | 31.1 | 54.8 | 3.3 | 10.7 | 890 | 540 | 120 | 81 |
| hCD73 | CD73.4-IgG1.1f | 1:1 | 2.5 | 2.5 | ~12.1 | ~13.1 | ~15.3 | ~17.0 | 55.2 | 44.5 | 2.1 | 2.2 | 1100 | 560 | 280 | 160 |
| hCD73 | CD73.4-IgG1.1f | 1:2 | 2.5 | 5 | ~12.3 | ~13.1 | ~15.3 | ~17.0 | 22.3 | 44.1 | 2.8 | 30.7 | 910 | 530 | 210 | 140 |
| hCD73 | CD73.4-IgG1.1f | 1:4 | 2.5 | 10 | ~12.3 | ~13.2 | ~15.3 | ~17.0 | 9.1 | 31.0 | 2.4 | 57.4 | 810 | 510 | 200 | 140 |
| hCD73 | CD73.4-hybrid | 1:1 | 5 | 5 | ~13.9 | ~14.7 | ~15.9 | ~17.0 | 0.7 | 88.3 | 8.1 | 2.8 | 390 | 210 | 180 | 150 |
| hCD73 | CD73.4-hybrid | 1:1 | 2.5 | 2.5 | ~13.4 | ~16.9 |  |  | 1.7 | 98.3 |  |  | 360 | 210 |  |  |
| N-hCD73 | CD73.4-hybrid | 1:1 | 2.5 | 2.5 | ~15.9 | ~16.9 |  |  | 0.4 | 99.6 |  |  | 290 | 140 |  |  |
| N-hCD73 | CD73.4-hybrid | 0:1 | 0 | 5 | ~14.2 | ~15.9 |  |  | 0.6 | 1.2 | 98.2 |  | 81 | 120 | 140 |  |
| hCD73 | CD73.4-IgG1.1f | 1:1 | 2.5 | 2.5 | ~11.5 | ~13.4 | ~17.3 |  | 95.0 | 2.1 | 2.8 |  | 3400 | 970 | 480 |  |
| hCD73 | CD73.4-IgG2-C219S | 1:1 | 2.5 | 2.5 | ~11.5 | ~13.4 | ~17.3 |  | 94.7 | 2.3 | 3.0 |  | 3600 | 1100 | 580 |  |
| hCD73 | CD73.4-IgG2-C219S-IgG1.1f | 1:1 | 2.5 | 2.5 | ~11.8 | ~13.0 | ~15.1 | ~17.0 | 60.0 | 35.3 | 2.3 | 2.5 | 1300 | 550 | 270 | 160 |
| hCD73 | CD73.4-IgG1.1f | 1:1 | 2.5 | 2.5 | ~11.8 | ~16.9 |  |  | 96.2 | 3.2 | 0.9 |  | 2000 | 310 | 390 |  |
| hCD73 | CD73.4-IgG1.1f | 1:1 | 2.5 | 2.5 | ~11.8 | ~16.9 |  |  | 96.6 | 2.5 | 2.7 |  | 2000 | 320 | 170 |  |
| N-hCD73 | CD73.4-IgG2-C219S | 1:1 | 2.5 | 2.5 | ~12.1 | ~13.0 | ~16.5 |  | 35.1 | 62.1 |  |  | 1000 | 530 |  |  |
| N-hCD73 | CD73.4-IgG2-C219S-1.1 | 1:1 | 2.5 | 2.5 | ~17.3 | ~18.4 |  |  | 97.2 | 2.7 |  |  | 120 | 60 |  |  |
| hCD73 | CD73.4-hybrid | 1:0 | 5 | 0 | ~11.5 | ~13.4 | ~17.3 |  | 93.9 | 2.6 | 3.5 |  | 4800 | 1300 | 740 |  |
| hCD73 | CD73.4-IgG2-C219S-IgG1.1f | 1:1 | 5 | 5 | ~11.5 | ~13.4 | ~15.0 | ~17.3 | 84.4 | 7.6 | 2.5 | 5.4 | 2900 | 660 | 460 | 240 |

* Molar concentrations are defined as N-hCD73 monomer, 11F11-Fab monomer, hCD73-his dimer, and (bivalent) mAb

Fig. 29A

Table 26: DLS data for CD73/mAb complexes:

| Target | mAb | Molar ratio | [target] (uM) | [mAb] (uM) | DLS Rh | Rh SD | %Pd | %Pd SD | %Mass | %Mass SD |
|---|---|---|---|---|---|---|---|---|---|---|
| | CD73.10-igG1.1f | 0:1 | | 4 | 5.0 | 0.6 | 11.0 | 6.0 | 100.0 | 0.0 |
| | CD73.10-igG2-C219S | 0:1 | | 4 | 5.2 | 0.1 | 11.9 | 2.3 | 100.0 | 0.0 |
| | CD73.3-igG1.1f | 0:1 | | 4 | 5.1 | 0.5 | 11.6 | 6.9 | 100.0 | 0.0 |
| | 11F11-Fab | 0:1 | | 8 | 3.4 | 0.2 | 22.0 | 5.3 | 100.0 | 0.1 |
| hCD73-his | | 1:0 | 4 | | 4.3 | 0.3 | 10.6 | 5.2 | 99.8 | 0.2 |
| N-hCD73-his | | 1:0 | 8 | | 2.3 | 0.2 | 19.3 | 12.3 | 99.9 | 0.2 |
| hCD73-his | CD73.10-igG1.1f | 1:1 | 4 | 4 | 12.8 | 0.7 | 32.4 | 6.7 | 100.0 | 0.0 |
| hCD73-his | CD73.10-igG2-C219S | 1:1 | 4 | 4 | 2.9 | 1.5 | 7.5 | 0.8 | 73.9 | 11.5 |
| hCD73-his | CD73.3-igG1.1f | 1:1 | 4 | 4 | 10.8 | 0.1 | 28.2 | 0.6 | 100.0 | 0.0 |
| hCD73-his | 11F11-Fab | 1:2 | 4 | 8 | 6.4 | 0.1 | 15.1 | 4.3 | 100.0 | 0.0 |
| N-hCD73-his | CD73.10-igG1.1f | 2:1 | 8 | 4 | 6.6 | 0.3 | 15.3 | 6.5 | 100.0 | 0.0 |
| N-hCD73-his | CD73.10-igG2-C219S | 2:1 | 8 | 4 | 6.5 | 0.2 | 15.7 | 5.7 | 100.0 | 0.1 |
| N-hCD73-his | CD73.3-igG1.1f | 2:1 | 8 | 4 | 5.8 | 0.3 | 12.8 | 5.3 | 100.0 | 0.0 |
| N-hCD73-his | 11F11-Fab | 1:1 | 8 | 8 | 4.2 | 0.1 | 12.6 | 4.7 | 100.0 | 0.0 |
| hCD73 | | 1:0 | 2.5 | 0 | 4.5 | 0.1 | 12.3 | 4.3 | 99.9 | 0.2 |
| hCD73 | CD73.4-hybrid | 1:0.25 | 2.5 | 0.625 | 13.2 | 1.7 | 46.5 | 5.9 | 99.9 | 0.1 |
| hCD73 | CD73.4-hybrid | 1:0.5 | 2.5 | 1.25 | 17.5 | 1.0 | 31.7 | 8.8 | 62.6 | 25.8 |
| hCD73 | CD73.4-hybrid | 1:1 | 2.5 | 2.5 | 29.9 | 1.0 | 25.1 | 2.1 | 22.3 | 4.9 |
| hCD73 | CD73.4-hybrid | 1:2 | 2.5 | 5 | 14.4 | 0.1 | 31.3 | 5.5 | 68.7 | 25.8 |
| hCD73 | CD73.4-hybrid | 1:4 | 2.5 | 10 | 11.4 | 0.9 | 42.9 | 3.5 | 90.2 | 17.5 |
| hCD73 | | 1:0 | 2.5 | 0 | 4.7 | 0.1 | 18.6 | 3.3 | 99.8 | 0.1 |
| hCD73 | CD73.4-igG1.1f | 1:0.25 | 2.5 | 0.625 | 10.4 | 1.5 | 38.6 | 15.9 | 81.3 | 37.1 |
| hCD73 | CD73.4-igG1.1f | 1:0.5 | 2.5 | 1.25 | 12.9 | 0.6 | 35.5 | 5.4 | 88.3 | 23.2 |
| hCD73 | CD73.4-igG1.1f | 1:1 | 2.5 | 2.5 | 14.7 | 0.5 | 34.3 | 3.9 | 100.0 | 0.0 |
| hCD73 | CD73.4-igG1.1f | 1:2 | 2.5 | 5 | 11.6 | 0.4 | 24.9 | 8.5 | 65.0 | 32.5 |
| hCD73 | CD73.4-igG1.1f | 1:4 | 2.5 | 10 | 8.1 | 4.0 | 33.0 | 16.9 | 84.2 | 31.7 |
| N-hCD73 | CD73.4-hybrid | 1:1 | 5 | 2.5 | 6.7 | 0.3 | 13.9 | 7.0 | 100.0 | 0.0 |
| N-hCD73 | CD73.4-igG1.1f | 1:1 | 5 | 2.5 | 6.5 | 0.1 | 7.4 | 3.2 | 100.0 | 0.0 |
| | CD73.4-hybrid | 0:1 | 0 | 5 | 5.4 | 0.2 | 15.7 | 5.7 | 99.9 | 0.1 |
| | CD73.4-igG1.1f | 0:1 | 0 | 5 | 5.3 | 0.4 | 13.6 | 7.9 | 100.0 | 0.0 |
| hCD73 | CD73.4-igG2-C219S | 1:1 | 2.5 | 2.5 | 31.7 | 2.4 | 31.6 | 11.4 | 19.3 | 12.2 |
| hCD73 | CD73.4-IgG2-C219S-IgG1.1f | 1:1 | 2.5 | 2.5 | 31.2 | 0.9 | 30.8 | 3.8 | 17.5 | 11.4 |
| hCD73 | CD73.4-igG1.1f | 1:1 | 2.5 | 2.5 | 15.6 | 1.2 | 32.7 | 8.0 | 100.0 | 0.0 |
| hCD73 | CD73.10-igG2-C219S | 1:1 | 2.5 | 2.5 | 23.9 | 1.2 | 26.7 | 4.4 | 36.3 | 5.3 |
| hCD73 | CD73.10-igG2CS-1.1 | 1:1 | 2.5 | 2.5 | 25.6 | 2.3 | 30.1 | 8.8 | 35.9 | 9.1 |
| hCD73 | CD73.10-igG1.1f | 1:1 | 2.5 | 2.5 | 13.5 | 1.2 | 31.6 | 12.0 | 83.2 | 31.5 |
| hCD73 | | 1:0 | 2.5 | 0 | 4.2 | 0.8 | 24.4 | 12.8 | 99.1 | 0.7 |
| hCD73 | CD73.4-IgG2-C219S-IgG1.1f | 1:1 | 5 | 5 | 35.3 | 3.8 | 35.2 | 13.9 | 6.7 | 4.4 |
| hCD73 | CD73.4-IgG2-C219S-IgG1.1f | 1:1 | 1 | 1 | 25.5 | 3.2 | 32.9 | 2.9 | 60.7 | 27.5 |

\* Molar concentrations are defined as N-hCD73 monomer, 11F11-Fab monomer, hCD73-his dimer, and (bivalent) mAb

*Fig. 29B*

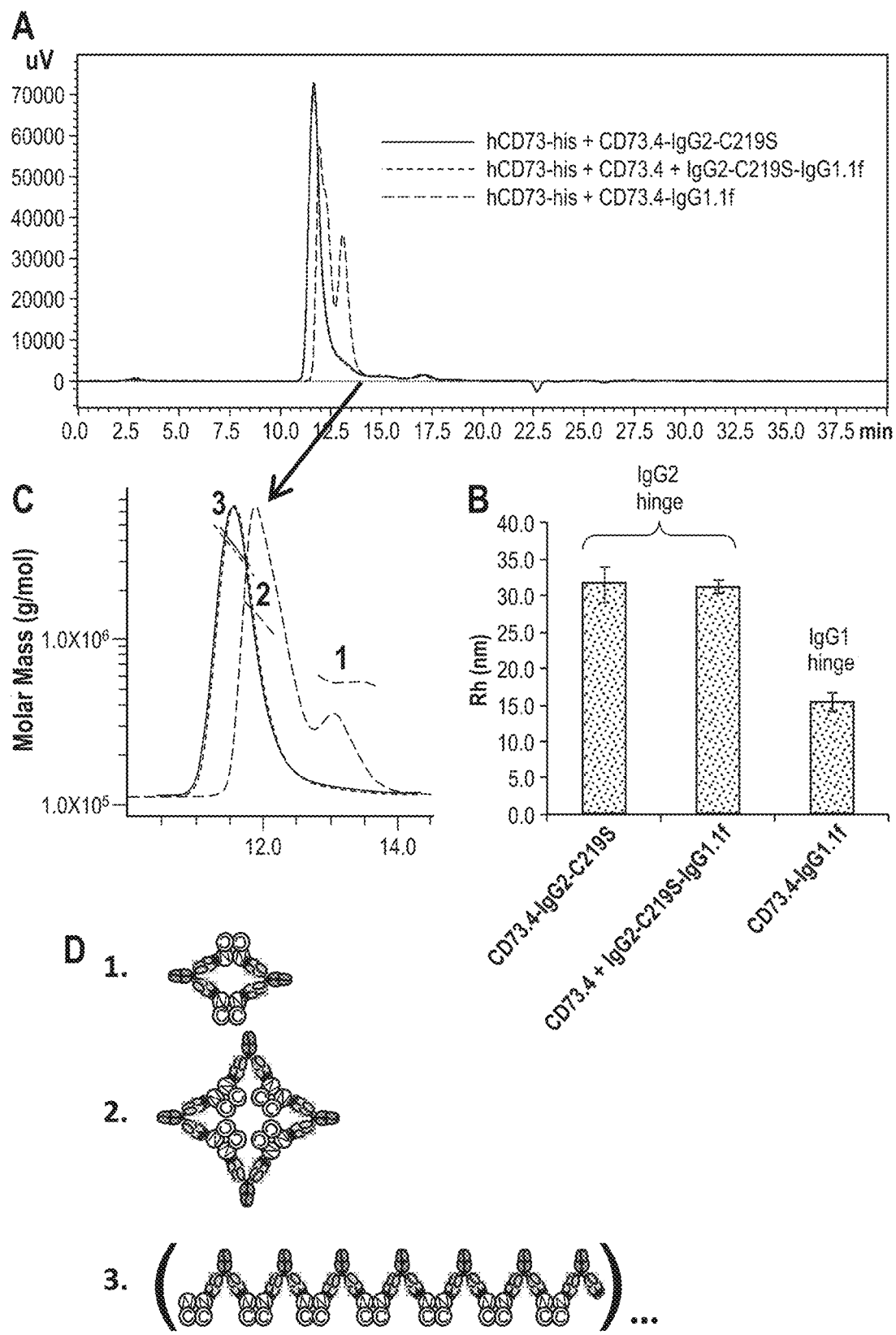
*Fig. 30A-D*

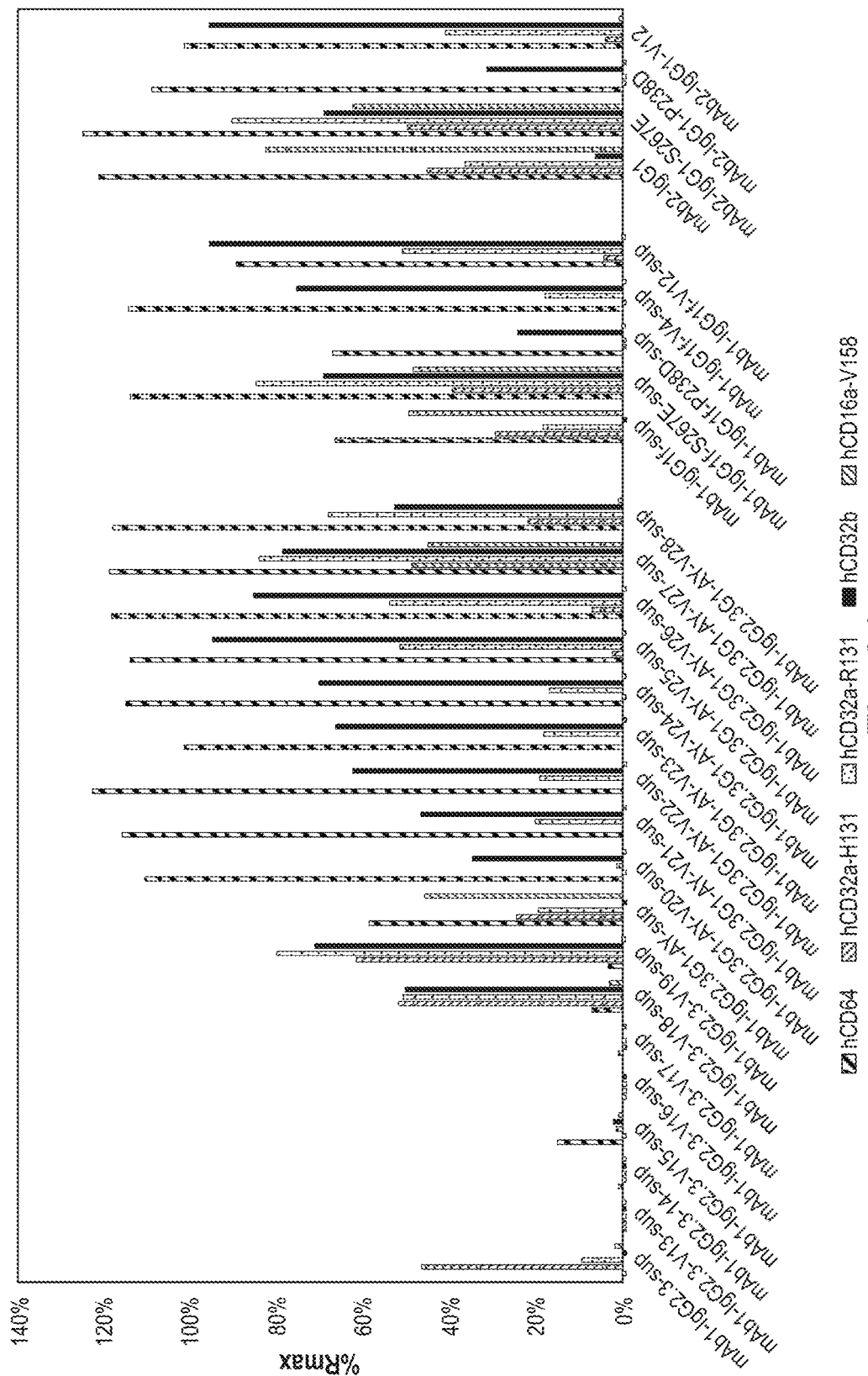

```
VH region alignment

11F11      QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
73.4       QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
73.5       QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
73.6       QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
73.7       QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
73.8       QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
73.9       QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
73.10      QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS
24H2       QVQLVESGGGVVQPGRSLRLSCAASGFTFSNYGMHWVRQAPGKGLEWVAVIWYDGSNKYYADSVKGRFTISRDNSKNTLFLQMNSLRAEDTAVYYCARGYNSRWYPDAFDIWGQGTMVTVSS
4D4        QVQLVESGGGVVQPGRSLRLSCAASGFTFSNYGMHWVRQAPGKGLEWVAVIWYDESNKYYADSVKGRFTISRDNSKNTLYLQMNSLRAEDTAVYYCARGGSSWYPDGLDVWGQGTTVTVSS
10D2       EVQLVESGGALVQPGRSLRLSCAASGFTFDDYAMHWVRQAPGKGLEWVSGITWNSGGTYYADSVKGRFTISRDNAKNSLYLQMNSLRAEDTALYYCAKDRYSSWLLFDNWGQGILVTVSS
6E11       EVQLVESGGGLVQTGSLRLSCAASGFTFDDYAMHWVRQAPGKGLEWVSDIGYADSVKGRFTISRDNAKNSLYLQMNSLRAEDTALYYCAKDIYGSSFFDYWGQGILVTVSS
7A11       EVQLVESGGGLVQPGRSLRLSCAASGFTFDDYAMHWVRQAPGKGLEWVSGISWNSDIIGYADSVKGRFIISRDNAKNSLYLQMNSLRPEDTALYYCVKGYVVILTGLDYWGQGTPVTVSS
11A6       EVQLVESGGGNLVQPGGSLRLSCAASGFTFDDYAMHWVRQAPGKGLEWVSGISWNNDIGYADSVKGRFIISRDNAKNSLYLQMNSLRPEDTALYYCVKGYVVILTGLDYWGQGTPVTVSS
4C3        EVQLVESGGGLVQPGGSLRLPLSCAASGFTFDDYAMHWVRQAPGKGLEWVSGISWKSGSIGYADSVKGRFTISRDNAKNSLYLQMNSLRAEDTALYYCVKGYVVILTGLDYWGQGTLVTVSS
73.3       EVQLVESGGGLVQPGGSLRLSCAASGFTFDDYAMHWVRQAPGKGLEWVSGISWKSGSIGLADSVKGRFTISRDNAKNSLILQMNELRAEDTAYYCVKGYVVILTGLDYWGQGTLVTVSS
5F8        EVQLVESGGGLVQPGGSLRLSCAASGFTSSYWMHWVRQAPGKGLVWVSRIISDGSTGYADSVKGRFTISRDNAKNTLYLQMNSLRAEDTAVYYCAREFSSGWYFDYWGQGTLVTVSS

VL region alignment

11F11-1    EIVLTQSPATLSLSPGERATLSCRASQSVSSYLAWYQQKPGQAPRLLIYDASNRATGIPARFSGSGSGTDFTLTISSLEPEDFAVYYCQQRSNWHLTFGGGTKVEIK
11F11-2    DIQMTQSPSSLSASVGDRVTFTCRASQGISSWLAWYQQKPEKAPKSLIYAASSLQSGVPSRFSGSGSGTDFTLTISSLQPEDFATYYCQQYNSYPLTFGGGTKVEIK
24H2       DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK
4D4        AIQLTQSPSSLSASVGDRVTITCRASQGISSALAWYQQKPGKAPKLLIYDASSLESGVPSRFSGSGSGTDFTLTISSLQPEDFATYYCQQFNSYPTFGGGTKVEIK
10D2-1     DIQMTQSPSSLSASVGDRVTITCRASQGISSWLAWYQQKPEEAPKSLIYAASSLQSGVPSRFSGSGSGTDFTLTISSLQPEDFATYYCQQYNSYPLTFGGGTKVEIK
10D2-2     DIQMTQSPSPSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK
6E11       EIVLTQSPGTLSLSPGERATLSCRASQGISSWLAWYQQKPGQAPRLLIYGASSRATGIPDRFSGSGSGTDFTLTISRLEPEDFAVYYCQHYGSSPFTFGPGRVDIK
7A11       DIQMTQSPSSLSASVGDRVTITCRASQSVSSYISSWLAWYQQKPEKAPKSLIYAASSLQSGVPSRFSGSGSGTDFTLTISSLQPEDFATYYCQQYHSYPFTFGQGTRLEIK
11A6       EIVLTQSPATLSLSPGERATLSCRASQSVSSYLAWYQQKPGQAPRLLIYGASSRATGIPDRFSGSGSGTDFTLTISRLEPEDFAVYYCQQYNSYPLTFGGGTKVEIK
4C3-1      DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKVEIK
4C3-2      DIQMTQSPSSLSASVGDRVFTCRASQGISSWLAWYQQKPEKAPKSLIYAASSLQSGVPSRFSGSGSGTDFTLTISSLQPEDFATYYCQQYNSYPPTFGQGTKVEIK
4C3-3      AIQLTQSPSSLSASVGDRVTITCRASQGISSALAWYQQKPEGAPKLLIYDASSLESGVPSRFSGSGSGTDFTLTISSLQPEDFATYYCQQFSSYPRTFGQGTKVEIK
5F8-1      DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK
5F8-2      DIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK
5F8-3      EIVLTQSPATLSLSPGERATLSCRASQSVSSYLAWYQQKPGQAPRLLIYDASNRATGIPARFSGSGSGTDFTLTISSLEPEDFAVYYCQQRSNWWTFGGGTKVEIK
```

ANTIBODIES AGAINST CD73

RELATED APPLICATIONS

This application is a continuation of PCT Application No. PCT/US2015/061639, entitled "Antibodies Against CD73 and Uses Thereof" filed Nov. 19, 2015 which claims the benefit of U.S. Provisional Application No. 62/083,056, entitled "Antibodies Against CD73 and Uses Thereof" filed on Nov. 21, 2014, the contents each of which are hereby incorporated by reference.

SEQUENCE LISTING

The instant application contains a Sequence Listing which has been submitted in ASCII format via EFS-Web and is hereby incorporated by reference in its entirety. Said ASCII copy, created on Jan. 13, 2016 is named MXI-538PCCN_Sequence_Listing.txt and is 609,249 bytes in size.

BACKGROUND

Cluster of Differentiation 73 (CD73), also known as ecto-5'-nucleotidase (ecto-5'NT, EC 3.1.3.5), is a glycosylphosphatidylinositol (GPI)-linked cell surface enzyme found in most tissues, but particularly expressed in endothelial cells and subsets of hematopoietic cells (Resta et al., *Immunol Rev* 1998; 161:95-109 and Colgan et al., *Prinergic Signal* 2006; 2:351-60). CD73 is known to catalyze the dephosphorylation of extracellular nucleoside monophosphates into nucleosides, such as adenosine. Adenosine is a widely studied signaling molecule which mediates its biological effects through several receptors, including A1, A2A, A2B, and A3. Adenosine has been shown to regulate proliferation and migration of many cancers and to have an immunosuppressive effect through the regulation of anti-tumor T cells (Zhang et al., *Cancer Res* 2010; 70:6407-11).

CD73 has been reported to be expressed on many different cancers, including colon, lung, pancreas, ovary, bladder, leukemia, glioma, glioblastoma, melanoma, thyroid, esophageal, prostate and breast cancers (Jin et al., *Cancer Res* 2010; 70:2245-55 and Stagg et al., *PNAS* 2010; 107: 1547-52). Moreover, CD73 expression in cancer has been linked to increased proliferation, migration, neovascularization, invasiveness, metastasis and shorter patient survival. CD73 activity has also been proposed as a prognostic marker in papillary thyroid carcinomas. While CD73 has been shown to regulate cell-cell and cell-matrix interactions on tumor cells, CD73 expression and activity has also been linked to reduced T-cell responses and implicated in drug resistance (Spychala et al., *Pharmacol Ther* 3000; 87:161-73). Thus CD73 can regulate cancer progression both directly and indirectly, which highlights its potential as a novel therapeutic target.

Given the ongoing need for improved strategies for targeting diseases such as cancer, methods of regulating tumor progression through multiple mechanisms, as well as methods for regulating CD73 activity and related therapeutic agents are highly desirable.

SUMMARY

Provided herein are isolated antibodies, such as monoclonal antibodies (antigen binding portions thereof), in particular human monoclonal antibodies, that specifically bind CD73 and have desirable functional properties. These properties include high affinity binding to human CD73, binding to monkey CD73 (e.g., cynomolgus CD73), and the ability to inhibit CD73 enzymatic activity. The antibodies described herein can be used to inhibit tumor growth, reduce adenosine production, stimulate an immune response, and detect CD73 protein in a sample.

In certain embodiments, the anti-CD73 antibodies exhibit at least one of the following properties:
(a) inhibition of CD73 enzymatic activity;
(b) binding to cynomolgus CD73;
(c) antibody mediated internalization of CD73 into cells, e.g., tumor cells; and
(d) binding to a conformational epitope comprising amino acids 65-83 and 157-172 of human CD73.

In certain embodiments, the anti-CD73 antibodies, or antigen binding portions thereof, bind to human CD73 (monomeric and/or dimeric CD73) with a $K_D$ of about 10 nM to 0.1 nM or less as measured, e.g., by BIACORE® SPR analysis, and is internalized into tumor cells with a $T_{1/2}$ of no more than 10 min as measured, e.g., by pulse chase and as described in the Examples.

In certain embodiments, the anti-CD73 antibodies, or antigen binding portions thereof, bind within the regions FTKVQQIRRAEPNVLLLDA (SEQ ID NO: 96) and/or LYLPYKVLPVGDEVVG (SEQ ID NO: 97) of human CD73, e.g., wherein the epitope spans or overlaps with FTKVQQIRRAEPNVLLLDA (SEQ ID NO: 96) and/or LYLPYKVLPVGDEVVG (SEQ ID NO: 97) of human CD73.

In certain embodiments, the anti-CD73 antibodies, or antigen binding portions thereof, bind to an epitope on human CD73 (SEQ ID NO: 1) which includes all or a portion of amino acid residues FTKVQQIRRAEPNVLLLDA (SEQ ID NO: 96) and/or LYLPYKVLPVGDEVVG (SEQ ID NO: 97). In certain embodiments, the epitope bound by the anti-CD73 antibodies, or antigen binding portions thereof, is determined by, e.g., HDX-MS and/or crystallography.

In certain embodiments, the anti-CD73 antibodies comprise the three variable heavy chain CDRs and the three variable light chain CDRs that are in the variable heavy chain and variable light chain pairs of anti-CD73 antibodies described herein, such as the chains in Table 35, e.g., SEQ ID NOs: 4 and 8; SEQ ID NOs: 4 and 12; SEQ ID NOs: 16 and 20; SEQ ID NOs: 16 and 24; SEQ ID NOs: 16 and 28; SEQ ID NOs: 32 and 36; SEQ ID NOs: 40 and 44; SEQ ID NOs: 40 and 48; SEQ ID NOs: 52 and 56; SEQ ID NOs: 60 and 64; SEQ ID NOs: 68 and 72; SEQ ID NOs: 68 and 76; SEQ ID NOs: 80 and 84; SEQ ID NOs: 88 and 92; SEQ ID NOs: 135 and 8; or SEQ ID NOs: 135 and 12. For example, the anti-CD73 antibodies comprise:

(a) heavy chain CDR1, CDR2, and CDR3 sequences comprising SEQ ID NOs: 5, 6, and 7, respectively, and/or light chain CDR1, CDR2, and CDR3 sequences comprising SEQ ID NOs: 9, 10, and 11, respectively;

(b) heavy chain CDR1, CDR2, and CDR3 sequences comprising SEQ ID NOs: 5, 6, and 7, respectively, and/or light chain CDR1, CDR2, and CDR3 sequences comprising SEQ ID NOs: 13, 14, and 15, respectively;

(c) heavy chain CDR1, CDR2, and CDR3 sequences comprising SEQ ID NOs: 17, 18, and 19, respectively, and/or light chain CDR1, CDR2, and CDR3 sequences comprising SEQ ID NOs: 21, 22, and 23, respectively;

(d) heavy chain CDR1, CDR2, and CDR3 sequences comprising SEQ ID NOs: 17, 18, and 19, respectively, and/or light chain CDR1, CDR2, and CDR3 sequences comprising SEQ ID NOs: 25, 26, and 27, respectively;

(e) heavy chain CDR1, CDR2, and CDR3 sequences comprising SEQ ID NOs: 17, 18, and 19, respectively, and/or light chain CDR1, CDR2, and CDR3 sequences comprising SEQ ID NOs: 29, 30, and 31, respectively;

(f) heavy chain CDR1, CDR2, and CDR3 sequences comprising SEQ ID NOs: 33, 34, and 35, respectively, and/or light chain CDR1, CDR2, and CDR3 sequences comprising SEQ ID NOs: 37, 38, and 39, respectively;

(g) heavy chain CDR1, CDR2, and CDR3 sequences comprising SEQ ID NOs: 41, 42, and 43, respectively, and/or light chain CDR1, CDR2, and CDR3 sequences comprising SEQ ID NOs: 45, 46, and 47, respectively;

(h) heavy chain CDR1, CDR2, and CDR3 sequences comprising SEQ ID NOs: 41, 42, and 43, respectively, and/or light chain CDR1, CDR2, and CDR3 sequences comprising SEQ ID NOs: 49, 50, and 51, respectively;

(i) heavy chain CDR1, CDR2, and CDR3 sequences comprising SEQ ID NOs: 53, 54, and 55, respectively, and/or light chain CDR1, CDR2, and CDR3 sequences comprising SEQ ID NOs: 57, 58, and 59, respectively;

(j) heavy chain CDR1, CDR2, and CDR3 sequences comprising SEQ ID NOs: 61, 62, and 63, respectively, and/or light chain CDR1, CDR2, and CDR3 sequences comprising SEQ ID NOs: 65, 66, and 67, respectively;

(k) heavy chain CDR1, CDR2, and CDR3 sequences comprising SEQ ID NOs: 69, 70, and 71, respectively, and/or light chain CDR1, CDR2, and CDR3 sequences comprising SEQ ID NOs: 73, 74, and 75, respectively;

(l) heavy chain CDR1, CDR2, and CDR3 sequences comprising SEQ ID NOs: 69, 70, and 71, respectively, and/or light chain CDR1, CDR2, and CDR3 sequences comprising SEQ ID NOs: 77, 78, and 79, respectively;

(m) heavy chain CDR1, CDR2, and CDR3 sequences comprising SEQ ID NOs: 81, 82, and 83, respectively, and/or light chain CDR1, CDR2, and CDR3 sequences comprising SEQ ID NOs: 85, 86, and 87, respectively; or (n) heavy chain CDR1, CDR2, and CDR3 sequences comprising SEQ ID NOs: 89, 90, and 91, respectively, and/or light chain CDR1, CDR2, and CDR3 sequences comprising SEQ ID NOs: 93, 94, and 95, respectively.

In certain embodiments, the anti-CD73 antibodies, or antigen binding portions thereof, comprise heavy chain CDR1, CDR2, and CDR3 sequences, SEQ ID NOs: 5, 6, and 7, respectively, and/or light chain CDR1, CDR2, and CDR3 sequences, SEQ ID NOs: 9, 10, and 11, respectively.

In certain embodiments, the anti-CD73 antibodies, or antigen binding portions thereof, comprise heavy chain CDR1, CDR2, and CDR3 sequences, SEQ ID NOs: 5, 6, and 7, respectively, and/or light chain CDR1, CDR2, and CDR3 sequences, SEQ ID NOs: 13, 14, and 15, respectively.

In certain embodiments, the anti-CD73 antibodies, or antigen binding portions thereof, comprise heavy and light chain variable regions having amino acid sequences which are at least 80% identical, e.g., at least 85% identical, at least 90% identical, at least 95% identical, at least 96% identical, at least 97% identical, at least 98% identical, or at least 99% identical or greater to the amino acid sequences of a heavy chain variable region of anti-CD73 antibodies described herein, e.g., comprising the amino acid sequence set forth in SEQ ID NOs: 4, 16, 32, 40, 52, 60, 68, 80, 88, 135, 170-177 and/or a light chain variable region of anti-CD73 antibodies described herein, e.g., comprising the amino acid sequence set forth in SEQ ID NOs: 8, 12, 20, 24, 28, 36, 44, 48, 56, 64, 72, 76, 84, or 92.

In certain embodiments, the anti-CD73 antibodies, or antigen binding portions thereof, comprise heavy chain and light chain variable region sequences which are at least 80% identical, e.g., at least 85% identical, at least 90% identical, at least 95% identical, at least 96% identical, at least 97% identical, at least 98% identical, or at least 99% identical or greater (e.g., 100%), to the amino acid sequences: SEQ ID NOs: 135 and 8; SEQ ID NOs: 135 and 12; SEQ ID NOs: 4 and 8; SEQ ID NOs: 4 and 12; SEQ ID NOs: 16 and 20; SEQ ID NOs: 16 and 24; SEQ ID NOs: 16 and 28; SEQ ID NOs: 32 and 36; SEQ ID NOs: 40 and 44; SEQ ID NOs: 40 and 48; SEQ ID NOs: 52 and 56; SEQ ID NOs: 60 and 64; SEQ ID NOs: 68 and 72; SEQ ID NOs: 68 and 76; SEQ ID NOs: 80 and 84; SEQ ID NOs: 88 and 92; SEQ ID NO: 170 and any one of SEQ ID NOs: 20, 24 and 28; any one of SEQ ID NOs: 171-176 and SEQ ID NO: 8 or 12; or SEQ ID NO: 177 and 36.

In certain embodiments, the anti-CD73 antibodies, or antigen binding portions thereof, comprise heavy and light chain variable regions selected from the group consisting of: SEQ ID NOs: 135 and 8; SEQ ID NOs: 135 and 12; SEQ ID NOs: 4 and 8; SEQ ID NOs: 4 and 12; SEQ ID NOs: 16 and 20; SEQ ID NOs: 16 and 24; SEQ ID NOs: 16 and 28; SEQ ID NOs: 32 and 36; SEQ ID NOs: 40 and 44; SEQ ID NOs: 40 and 48; SEQ ID NOs: 52 and 56; SEQ ID NOs: SEQ ID NOs: 60 and 64; SEQ ID NOs: 68 and 72; SEQ ID NOs: 68 and 76; SEQ ID NOs: 80 and 84; SEQ ID NOs: 88 and 92; SEQ ID NO: 170 and any one of SEQ ID NOs: 20, 24 and 28; any one of SEQ ID NOs: 171-176 and SEQ ID NO: 8 or 12; or SEQ ID NOs: 177 and 36.

In certain embodiments, the antibody or antigen binding portion thereof, comprises a heavy chain variable region having the amino acid sequence set forth in SEQ ID NO: 135 and a light chain variable region having the amino acid sequence set forth in SEQ ID NO: 8 or SEQ ID NO: 12.

Provided herein are anti-CD73 antibodies, or antigen binding portions thereof, respectively, having full length heavy chain and light chain sequences at least 80%, 85%, 90%, 95%, 96%, 97%, 98% 99% or 100% identical to the amino acid sequences of any anti-CD73 antibody described herein, e.g., SEQ ID NOs: 100 and 101; SEQ ID NOs: 100 and 102; SEQ ID NOs: 103 and 104; SEQ ID NOs: 103 and 105; SEQ ID NOs: 103 and 106; SEQ ID NOs: 107 and 108; SEQ ID NOs: 109 and 110; SEQ ID NOs: 109 and 111; SEQ ID NOs: 112 and 113; SEQ ID NOs: 114 and 115; SEQ ID NOs: 116 and 117; SEQ ID NOs: 116 and 118; SEQ ID NOs: 119 and 120; SEQ ID NOs: 121 and 122; SEQ ID NOs: 133 or 189 (without C-terminal lysine) and 101; SEQ ID NOs: 133 or 189 and 102; SEQ ID NOs: 189 and 101; SEQ ID NOs: 189 and 102; any one of SEQ ID NOs: 184-186 and any one of SEQ ID NOs: 104-106; any one of SEQ ID NOs: 187-207 and SEQ ID NO: 101 or 102; or any one of SEQ ID NOs: 208-210 and SEQ ID NO: 108.

In certain embodiments, the antibody or antigen binding portion thereof, comprises a heavy chain region having the amino acid sequence set forth in SEQ ID NO: 133 or 189 and a light chain region having the amino acid sequence set forth in SEQ ID NO: 101 or SEQ ID NO: 102.

In certain embodiments, the anti-CD73 antibodies, or antigen-binding portions thereof, are IgG1, IgG2, IgG3, or IgG4 antibodies, or variants thereof. In certain embodiments, the anti-CD73 antibodies, or antigen binding portions thereof, bind the same epitope on CD73 as the antibodies having the foregoing heavy and light chain variable regions sequences (e.g., antibodies CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11).

In certain embodiments, the anti-CD73 antibodies, or antigen binding portions thereof, comprise a modified heavy chain constant region which includes, e.g., a human CH1 domain, a human hinge domain, a human CH2 domain, and a human CH3 domain in order from N- to C-terminus, wherein at least 2 domains are of a different isotype (e.g., IgG1, IgG2, IgG3, and IgG4 isotypes). For example, in certain embodiments, a modified constant region comprises a human IgG2 hinge and at least one of the CH1, CH2, and CH3 domains is not of an IgG2 isotype. In certain embodiments, CH1 is a human IgG2 CH1 domain, e.g., having the amino acid sequence ASTKGPSVFPLAPCSRSTSES-TAALGCLVKDYFPEPVTVSWNSGALTSGVHTFPAV-LQSS GLYSLSSVVTVPSSNFGTQTYTCNVDHKPSNT-KVDKTV (SEQ ID NO: 124). The modified constant region may include a human IgG2 hinge domain, e.g., a human IgG2 hinge domain which reduces heterogeneity in the cysteine binding, e.g., a human IgG2 hinge domain having amino acid substitution at C219, e.g., C219S, relative to a wildtype human IgG2 hinge domain (SEQ NO 136), e.g., a human IgG2 hinge domain having the amino acid sequence ERKSCVECPPCPAPPVAG (SEQ ID NO: 123). The modified constant region may include a human IgG1 CH2 domain which reduces or eliminates effector functions, e.g., a human IgG1 CH2 domain having amino acid substitutions A330S and P331S, relative to a wildtype human IgG1 CH2 domain (SEQ ID NO: 137), e.g., a human IgG1 CH2 domain comprises the amino acid sequence PSVFLFPPKP-KDTLMISRTPEVTCVVVDVSHEDPEVKFN-WYVDGVEVHNAKTKPREEQY NSTYRVVSVLTVL-HQDWLNGKEYKCKVSNKALPSSIEKTISKAK (SEQ ID NO: 125). The modified constant region may include a wildtype human IgG1 CH3 domain, e.g., having the amino acid sequence GQPREPQVYTLPPSREEMTKNQVSLT-CLVKGFYPSDIAVEWESNGQPENNYKTTPPVLD SDGSFFLYSKLTVDKSRWQQGNVFSCSVMHEALHN-HYTQKSLSLSPGK (SEQ ID NO: 128).

In certain embodiments, an anti-CD73 antibody comprises a modified heavy chain region, e.g., comprising (i) an IgG2 hinge or (ii) an IgG2 hinge and IgG CH1 domain, with the proviso that the antibody is not an IgG2 antibody, e.g., the antibody does not comprise a wildtype IgG2 heavy chain constant region.

In certain embodiments, the anti-CD73 antibodies, or antigen binding portions thereof, comprise any one of the constant regions described herein, e.g., constant regions comprising the amino acid sequences set forth in SEQ ID NOs: 126, 127, 129, 130, 162-169, 180-183, 267-282, and 300-347.

In certain embodiments, an anti-CD73 antibody comprises the VH and VL domains of 11F11 or CD73.4, and a heavy chain constant region comprising an IgG2 hinge or a heavy chain constant region comprising an IgG2 hinge and IgG2 CH1 domain. The heavy chain constant region may be IgG2CS-IgG1.1f (SEQ ID NO: 169) or IgG2CS-IgG1f (SEQ ID NO: 165), wherein "CS" refers to "C219S."

Provided herein are bispecific molecules comprising the anti-CD73 antibodies, or antigen binding portions thereof, linked to a molecule having a second binding specificity, as well as immunoconjugates comprising the anti-CD73 antibodies, or antigen binding portions thereof, linked to an agent.

Nucleic acid molecules encoding the heavy and/or light chain variable region sequences of the anti-CD73 antibodies are also provided, as well as expression vectors comprising the nucleic acid molecules, and cells transformed with the expression vectors.

Compositions and kits comprising anti-CD73 antibodies, or antigen binding portions thereof, are also provided.

Provided herein is a method of preparing anti-CD73 antibodies, comprising expressing an anti-CD73 antibody disclosed herein in a cell and isolating the antibody from the cell.

Methods of using the anti-CD73 antibodies disclosed herein are also provided, e.g., methods of decreasing adenosine levels, e.g., in or by a tumor, e.g., a tumor cell, expressing CD73, methods of stimulating an antigen-specific T cell response, methods of stimulating an immune response in a subject, methods of inhibiting the growth of tumor cells in a subject, methods of treating cancer, e.g., by immunotherapy. In certain embodiments, the cancer is bladder cancer, breast cancer, uterine/cervical cancer, ovarian cancer, prostate cancer, testicular cancer, esophageal cancer, gastrointestinal cancer, pancreatic cancer, colorectal cancer, colon cancer, kidney cancer, head and neck cancer, lung cancer, stomach cancer, germ cell cancer, bone cancer, liver cancer, thyroid cancer, skin cancer, neoplasm of the central nervous system, lymphoma, leukemia, myeloma, sarcoma, or virus-related cancer. The cancer may be a metastatic cancer, refractory cancer, or recurrent cancer.

In certain embodiments, the methods described herein further comprise administering one or more additional therapeutics, e.g., a therapeutic that stimulates the immune system, e.g., a PD-1 antagonist, a CTLA-4 antagonist, a LAG-3 antagonist, a GITR antagonist, and/or an anti-CD39 antibody, an anti-A2AR antibody, or chemical inhibitor of A2AR.

Other features and advantages of the instant disclosure will be apparent from the following detailed description and examples, which should not be construed as limiting.

BRIEF DESCRIPTION OF THE DRAWINGS

FIG. 1A shows the nucleotide sequence (SEQ ID NO: 237) and amino acid sequence (SEQ ID NO: 135) of the heavy chain variable region of the CD73.4-1 human monoclonal antibody. The CDR1 (SEQ ID NO: 5), CDR2 (SEQ ID NO: 6) and CDR3 (SEQ ID NO: 7) regions are delineated and the V, D and J germline derivations are indicated.

FIG. 1B shows the nucleotide sequence (SEQ ID NO: 140) and amino acid sequence (SEQ ID NO: 8) of the light chain variable region (VK1) of the CD73.4-1 human monoclonal antibody. The CDR1 (SEQ ID NO: 9), CDR2 (SEQ ID NO: 10) and CDR3 (SEQ ID NO: 11) regions are delineated and the V, D and J germline derivations are indicated.

FIG. 2A shows the nucleotide sequence (SEQ ID NO: 237) and amino acid sequence (SEQ ID NO: 135) of the heavy chain variable region of the CD73.4-2 human monoclonal antibody. The CDR1 (SEQ ID NO: 5), CDR2 (SEQ ID NO: 6) and CDR3 (SEQ ID NO: 7) regions are delineated and the V, D and J germline derivations are indicated.

FIG. 2B shows the nucleotide sequence (SEQ ID NO: 141) and amino acid sequence (SEQ ID NO: 12) of the light chain variable region of the CD73.4-2 human monoclonal antibody. The CDR1 (SEQ ID NO: 13), CDR2 (SEQ ID NO: 14) and CDR3 (SEQ ID NO: 15) regions are delineated and the V, D and J germline derivations are indicated.

FIG. 3A shows the nucleotide sequence (SEQ ID NO: 139) and amino acid sequence (SEQ ID NO: 4) of the heavy chain variable region of the 11F11-1 human monoclonal antibody. The CDR1 (SEQ ID NO: 5), CDR2 (SEQ ID NO: 6) and CDR3 (SEQ ID NO: 7) regions are delineated and the V, D and J germline derivations are indicated.

FIG. 3B shows the nucleotide sequence (SEQ ID NO: 140) and amino acid sequence (SEQ ID NO: 8) of the light chain variable region of the 11F11-1 human monoclonal antibody. The CDR1 (SEQ ID NO: 9), CDR2 (SEQ ID NO: 10) and CDR3 (SEQ ID NO: 11) regions are delineated and the V, D and J germline derivations are indicated.

FIG. 4A shows the nucleotide sequence (SEQ ID NO: 139) and amino acid sequence (SEQ ID NO: 4) of the heavy chain variable region of the 11F11-2 human monoclonal antibody. The CDR1 (SEQ ID NO: 5), CDR2 (SEQ ID NO: 6) and CDR3 (SEQ ID NO: 7) regions are delineated and the V, D and J germline derivations are indicated.

FIG. 4B shows the nucleotide sequence (SEQ ID NO: 141) and amino acid sequence (SEQ ID NO: 12) of the light chain variable region of the 11F11-2 human monoclonal antibody. The CDR1 (SEQ ID NO: 13), CDR2 (SEQ ID NO: 14) and CDR3 (SEQ ID NO: 15) regions are delineated and the V, D and J germline derivations are indicated.

FIG. 5A shows the nucleotide sequence (SEQ ID NO: 142) and amino acid sequence (SEQ ID NO: 16) of the heavy chain variable region of the 4C3-1 human monoclonal antibody. The CDR1 (SEQ ID NO: 17), CDR2 (SEQ ID NO: 18) and CDR3 (SEQ ID NO: 19) regions are delineated and the V, D and J germline derivations are indicated.

FIG. 5B shows the nucleotide sequence (SEQ ID NO: 143) and amino acid sequence (SEQ ID NO: 20) of the light chain variable region of the 4C3-1 human monoclonal antibody. The CDR1 (SEQ ID NO: 21), CDR2 (SEQ ID NO: 22) and CDR3 (SEQ ID NO: 23) regions are delineated and the V, D and J germline derivations are indicated.

FIG. 6A shows the nucleotide sequence (SEQ ID NO: 142) and amino acid sequence (SEQ ID NO: 16) of the heavy chain variable region of the 4C3-2 human monoclonal antibody. The CDR1 (SEQ ID NO: 17), CDR2 (SEQ ID NO: 18) and CDR3 (SEQ ID NO: 19) regions are delineated and the V, D and J germline derivations are indicated.

FIG. 6B shows the nucleotide sequence (SEQ ID NO: 144) and amino acid sequence (SEQ ID NO: 24) of the light chain variable region of the 4C3-2 human monoclonal antibody. The CDR1 (SEQ ID NO: 25), CDR2 (SEQ ID NO: 26) and CDR3 (SEQ ID NO: 27) regions are delineated and the V, D and J germline derivations are indicated.

FIG. 7A shows the nucleotide sequence (SEQ ID NO: 142) and amino acid sequence (SEQ ID NO: 16) of the heavy chain variable region of the 4C3-3 human monoclonal antibody. The CDR1 (SEQ ID NO: 17), CDR2 (SEQ ID NO: 18) and CDR3 (SEQ ID NO: 19) regions are delineated and the V, D and J germline derivations are indicated.

FIG. 7B shows the nucleotide sequence (SEQ ID NO: 145) and amino acid sequence (SEQ ID NO: 28) of the light chain variable region of the 4C3-3 human monoclonal antibody. The CDR1 (SEQ ID NO: 29), CDR2 (SEQ ID NO: 30) and CDR3 (SEQ ID NO: 31) regions are delineated and the V, D and J germline derivations are indicated.

FIG. 8A shows the nucleotide sequence (SEQ ID NO: 146) and amino acid sequence (SEQ ID NO: 32) of the heavy chain variable region of the 4D4-1 human monoclonal antibody. The CDR1 (SEQ ID NO: 33), CDR2 (SEQ ID NO: 34) and CDR3 (SEQ ID NO: 35) regions are delineated and the V, D and J germline derivations are indicated.

FIG. 8B shows the nucleotide sequence (SEQ ID NO: 147) and amino acid sequence (SEQ ID NO: 36) of the light chain variable region of the 4D4-1 human monoclonal antibody. The CDR1 (SEQ ID NO: 37), CDR2 (SEQ ID NO: 38) and CDR3 (SEQ ID NO: 39) regions are delineated and the V, D and J germline derivations are indicated.

FIG. 9A shows the nucleotide sequence (SEQ ID NO: 148) and amino acid sequence (SEQ ID NO: 40) of the heavy chain variable region of the 10D2-1 human monoclonal antibody. The CDR1 (SEQ ID NO: 41), CDR2 (SEQ ID NO: 42) and CDR3 (SEQ ID NO: 43) regions are delineated and the V, D and J germline derivations are indicated.

FIG. 9B shows the nucleotide sequence (SEQ ID NO: 149) and amino acid sequence (SEQ ID NO: 44) of the light chain variable region of the 10D2-1 human monoclonal antibody. The CDR1 (SEQ ID NO: 45), CDR2 (SEQ ID NO: 46) and CDR3 (SEQ ID NO: 47) regions are delineated and the V, D and J germline derivations are indicated.

FIG. 10A shows the nucleotide sequence (SEQ ID NO: 148) and amino acid sequence (SEQ ID NO: 40) of the heavy chain variable region of the 10D2-2 human monoclonal antibody. The CDR1 (SEQ ID NO: 41), CDR2 (SEQ ID NO: 42) and CDR3 (SEQ ID NO: 43) regions are delineated and the V, D and J germline derivations are indicated.

FIG. 10B shows the nucleotide sequence (SEQ ID NO: 150) and amino acid sequence (SEQ ID NO: 48) of the light chain variable region of the 10D2-2 human monoclonal antibody. The CDR1 (SEQ ID NO: 49), CDR2 (SEQ ID NO: 50) and CDR3 (SEQ ID NO: 51) regions are delineated and the V, D and J germline derivations are indicated.

FIG. 11A shows the nucleotide sequence (SEQ ID NO: 151) and amino acid sequence (SEQ ID NO: 52) of the heavy chain variable region of the 11A6-1 human monoclonal antibody. The CDR1 (SEQ ID NO: 53), CDR2 (SEQ ID NO: 54) and CDR3 (SEQ ID NO: 55) regions are delineated and the V, D and J germline derivations are indicated.

FIG. 11B shows the nucleotide sequence (SEQ ID NO: 152) and amino acid sequence (SEQ ID NO: 56) of the light chain variable region of the 11A6-1 human monoclonal antibody. The CDR1 (SEQ ID NO: 57), CDR2 (SEQ ID NO: 58) and CDR3 (SEQ ID NO: 59) regions are delineated and the V, D and J germline derivations are indicated.

FIG. 12A shows the nucleotide sequence (SEQ ID NO: 153) and amino acid sequence (SEQ ID NO: 60) of the heavy chain variable region of the 24H2-1 human monoclonal antibody. The CDR1 (SEQ ID NO: 61), CDR2 (SEQ ID NO: 62) and CDR3 (SEQ ID NO: 63) regions are delineated and the V, D and J germline derivations are indicated.

FIG. 12B shows the nucleotide sequence (SEQ ID NO: 154) and amino acid sequence (SEQ ID NO: 64) of the light chain variable region of the 24H2-1 human monoclonal antibody. The CDR1 (SEQ ID NO: 65), CDR2 (SEQ ID NO: 66) and CDR3 (SEQ ID NO: 67) regions are delineated and the V, D and J germline derivations are indicated.

FIG. 13A shows the nucleotide sequence (SEQ ID NO: 155) and amino acid sequence (SEQ ID NO: 68) of the heavy chain variable region of the 5F8-1 human monoclonal antibody. The CDR1 (SEQ ID NO: 69), CDR2 (SEQ ID NO: 70) and CDR3 (SEQ ID NO: 71) regions are delineated and the V, D and J germline derivations are indicated.

FIG. 13B shows the nucleotide sequence (SEQ ID NO: 156) and amino acid sequence (SEQ ID NO: 72) of the light chain variable region of the 5F8-1 human monoclonal antibody. The CDR1 (SEQ ID NO: 73), CDR2 (SEQ ID NO: 74) and CDR3 (SEQ ID NO: 75) regions are delineated and the V, D and J germline derivations are indicated.

FIG. 14A shows the nucleotide sequence (SEQ ID NO: 155) and amino acid sequence (SEQ ID NO: 68) of the heavy chain variable region of the 5F8-2 human monoclonal antibody. The CDR1 (SEQ ID NO: 69), CDR2 (SEQ ID NO: 70) and CDR3 (SEQ ID NO: 71) regions are delineated and the V, D and J germline derivations are indicated.

FIG. 14B shows the nucleotide sequence (SEQ ID NO: 157) and amino acid sequence (SEQ ID NO: 76) of the light chain variable region of the 5F8-2 human monoclonal antibody. The CDR1 (SEQ ID NO: 77), CDR2 (SEQ ID NO: 78) and CDR3 (SEQ ID NO: 79) regions are delineated and the V, D and J germline derivations are indicated.

FIG. 15A shows the nucleotide sequence (SEQ ID NO: 155) and amino acid sequence (SEQ ID NO: 68) of the heavy chain variable region of the 5F8-3 human monoclonal antibody. The CDR1 (SEQ ID NO: 69), CDR2 (SEQ ID NO: 70) and CDR3 (SEQ ID NO: 71) regions are delineated and the V, D and J germline derivations are indicated.

FIG. 15B shows the nucleotide sequence (SEQ ID NO: 242) and amino acid sequence (SEQ ID NO: 238) of the light chain variable region of the 5F8-3 human monoclonal antibody. The CDR1 (SEQ ID NO: 239), CDR2 (SEQ ID NO: 240) and CDR3 (SEQ ID NO: 241) regions are delineated and the V, D and J germline derivations are indicated.

FIG. 16A shows the nucleotide sequence (SEQ ID NO: 158) and amino acid sequence (SEQ ID NO: 80) of the heavy chain variable region of the 6E11-1 human monoclonal antibody. The CDR1 (SEQ ID NO: 81), CDR2 (SEQ ID NO: 82) and CDR3 (SEQ ID NO: 83) regions are delineated and the V, D and J germline derivations are indicated.

FIG. 16B shows the nucleotide sequence (SEQ ID NO: 159) and amino acid sequence (SEQ ID NO: 84) of the light chain variable region of the 6E11-1 human monoclonal antibody. The CDR1 (SEQ ID NO: 85), CDR2 (SEQ ID NO: 86) and CDR3 (SEQ ID NO: 87) regions are delineated and the V, D and J germline derivations are indicated.

FIG. 17A shows the nucleotide sequence (SEQ ID NO: 160) and amino acid sequence (SEQ ID NO: 88) of the heavy chain variable region of the 7A11-1 human monoclonal antibody. The CDR1 (SEQ ID NO: 89), CDR2 (SEQ ID NO: 90) and CDR3 (SEQ ID NO: 91) regions are delineated and the V, D and J germline derivations are indicated.

FIG. 17B shows the nucleotide sequence (SEQ ID NO: 161) and amino acid sequence (SEQ ID NO: 92) of the light chain variable region of the 7A11-1 human monoclonal antibody. The CDR1 (SEQ ID NO: 93), CDR2 (SEQ ID NO: 94) and CDR3 (SEQ ID NO: 95) regions are delineated and the V, D and J germline derivations are indicated.

FIG. 18 shows the amino acid sequence (SEQ ID NO: 189) of the heavy chain of anti-CD73 antibody CD73.4-IgG2CS-IgG1.1f, and its variable region, CDRs 1, 2 and 3, CH1, Hinge, CH2 and CH3 domains.

FIGS. 20A1 and 20A2 show the binding of the 11F11, CD73.4 and CD73.10 antibodies with the indicated heavy chain constant regions to human CD73 positive Calu6 cells (human pulmonary adenocarcinoma cell line).

FIGS. 20B1 and 20B2 show the binding of the 11F11, CD73.4 and CD73.10 antibodies with the indicated heavy chain constant regions to human CD73 negative DMS 114 cells (small lung cell carcinoma cell line).

FIGS. 20C1 and 20C2 show the binding of the 11F11, CD73.4 and CD73.10 antibodies with the indicated heavy chain constant regions to cyno CD73 positive CHO cells.

FIGS. 20D1 and 20D2 show the binding of the 11F11, CD73.4 and CD73.10 antibodies with the indicated heavy chain constant regions to cyno CD73 negative CHO-K1 cells.

FIGS. 21A1 and 21A2 show the inhibition of bead bound human CD73 enzymatic activity by the anti-CD73 antibodies 11F11, CD73.4 and CD73.10 with the indicated heavy chain constant regions. All antibodies inhibited human CD73 enzymatic activity.

FIGS. 21B1 and 21B2 show the inhibition of bead bound cyno CD73 enzymatic activity by the anti-CD73 antibodies 11F11, CD73.4 and CD73.10 with the indicated heavy chain constant regions. All antibodies inhibited cyno CD73 enzymatic activity.

FIGS. 22A1 and 22A2 show CD73 enzymatic inhibition in human CD73 positive Calu6 cells by the 11F11, CD73.4 and CD73.10 antibodies with the indicated heavy chain constant regions. All antibodies inhibited CD73 enzymatic activity in these cells.

FIGS. 22B1 and 22B2 show CD73 enzymatic inhibition in human CD73 negative DMS-114 cells by the 11F11, CD73.4 and CD73.10 antibodies with the indicated heavy chain constant regions.

FIG. 22C shows EC50 and Ymax values of inhibition of endogenous CD73 activity by 11F11 and 11F11 F(ab')$_2$ fragments, as determined in cAMP assay using Calu-6 and HEK/A2R cells. FIG. 22C also shows the EC50 and Ymax values of 11F11 and 11F11 F(ab')$_2$ fragments in a Calu-6 internalization assay. The Figure shows that an 11F11 Fab fragment is inactive in these two assays.

FIG. 22D shows a time course of adenosine production from Calu6 cells treated with the 11F11 or 4C3 antibody, as measured by LC/MS/MS, indicating that CD73 enzymatic inhibition by the 11F11 antibody occurs faster than that by the 4C3 antibody.

FIG. 23K shows the percentage of CD73 internalized in Calu6 cells treated with the indicated antibodies over time, showing antibody mediated CD73 internalization of the indicated antibodies in Calu6 cells over time.

FIG. 23L shows the percentage of CD73 internalized in NCI-H292 cells treated with the indicated antibodies over time, showing antibody mediated CD73 internalization of the indicated antibodies in Calu6 cells over time.

FIG. 24A shows xenograft tumor sections from animals harvested 4 days after treatment of the animals with a control antibody and stained for CD73 enzymatic activity. The sections show a dense brown color, indicating CD73 enzymatic activity.

FIG. 24B shows xenograft tumor sections from animals harvested 1 day after treatment of the animals with the 11F11 antibody and stained for CD73 enzymatic activity. The sections show significantly less brown color relative to the control tumor sections shown in FIG. 24A, indicating in vivo inhibition of CD73 enzymatic activity by CD73.10-IgG2CS-IgG1.1f as early as 1 day after the start of the treatment.

FIG. 24C shows xenograft tumor sections from animals harvested 2 days after treatment of the animals with CD73.10-IgG2CS-IgG1.1f and stained for CD73 enzymatic activity. The sections show significantly less brown color relative to the control tumor sections shown in FIG. 24A and relative to the tumor sections after 1 day of treatment of the animals with CD73.10-IgG2CS-IgG1.1f, indicating in vivo inhibition of CD73 enzymatic activity by CD73.10-IgG2CS-IgG1.1f at least 2 days after the start of the treatment.

FIG. 24D shows xenograft tumor sections from animals harvested 3 days after treatment of the animals with CD73.10-IgG2CS-IgG1.1f and stained for CD73 enzymatic activity. The sections show significantly less brown color relative to the control tumor sections shown in FIG. 24A, indicating in vivo inhibition of CD73 enzymatic activity by CD73.10-IgG2CS-IgG1.1f at least 3 days after the start of the treatment.

FIG. 25A shows levels of mouse CD73 enzymatic activity in control tumor sections from Balb/c mice bearing syngeneic 4T1 tumors and control mIgG.

FIG. 26A shows the level of cross-blocking of 4C3 by the anti-CD73 antibodies 4C3, 7A11, 6E11, 5F8, 4C3, 11F11 and 11A6 as determined by flow cytometry.

FIG. 26B shows the level of cross-blocking of 11F11 by the anti-CD73 antibodies 4C3, 7A11, 6E11, 5F8, 4C3, 11F11 and 11A6 as determined by flow cytometry.

FIG. 29A shows SEC-MALS data for human CD73 and antibody complexes. "CD73.4-hybrid" refers to CD73.4-IgG2CS-IgG1.1f.

FIG. 29B shows DLS data for human CD73 and antibody complexes.

FIG. 30A shows SEC chromatogram data for complexes of hCD73-his with the CD73.4 antibody containing different constant regions, showing the effect of an IgG2 hinge and CH1 domain on the size of antibody/antigen complexes.

FIG. 30B shows DLS data for complexes of hCD73-his with the CD73.4 antibody containing different constant regions, showing the effect of an IgG2 hinge and CH1 domain on the size of antibody/antigen complexes.

FIG. 30C shows MALS data for complexes of hCD73-his with the CD73.4 antibody containing different constant regions, showing the effect of an IgG2 hinge and CH1 domain on the size of antibody/antigen complexes.

FIG. 30D shows a schematic model of the hCD73-his/mAb complexes derived from the MALS-determined masses in FIG. 30C.

FIG. 34 shows antibody binding to anti-his Fab captured FcgR-his proteins. Binding responses are plotted as a percentage of the theoretical Rmax assuming a 1:1 mAb:FcγR binding stoichiometry. The bars for each antibody are shown in the order provided by the color legends at the bottom of the slide.

FIG. 35 shows an alignment of the VH and VL sequences of various anti-CD73 antibodies. VH and VL CDR1, CDR2 and CDR3 sequences are bolded.

DETAILED DESCRIPTION

Figure 19:
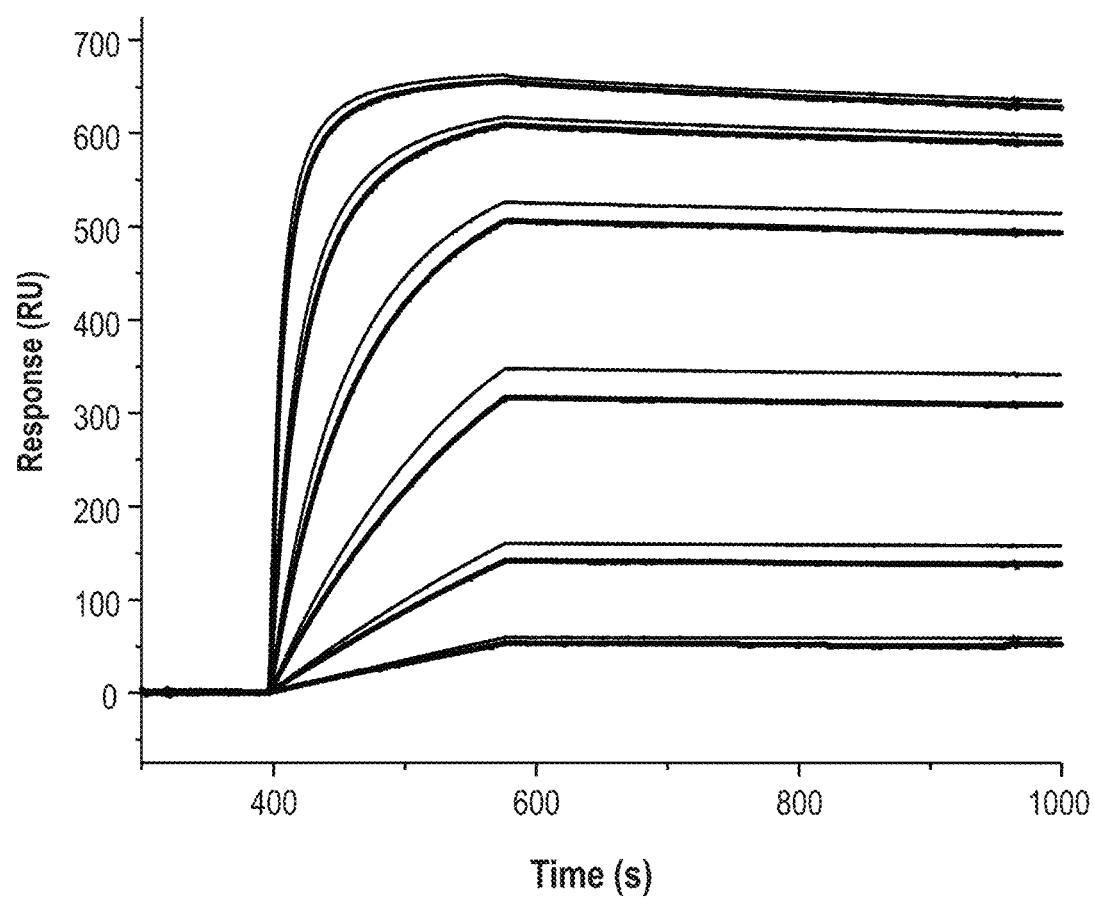
FIG. 19 shows SPR sensorgram data for the binding of 600, 200, 66.7, 22.2, 7.4, and 2.5 nM human-CD73-his (thick lines) or cyno-CD73-his (thin lines) to CD73.4-IgG2-C219S-IgG1.1f captured on an immobilized protein A surface at 25° C.

Described herein are isolated antibodies, particularly monoclonal antibodies, e.g., human monoclonal antibodies, which specifically bind to CD73 and thereby reduce CD73 activity ("antagonist anti-CD73 antibodies"). In certain embodiments, the antibodies described herein are derived from particular heavy and light chain germline sequences and/or comprise particular structural features such as CDR regions comprising particular amino acid sequences. Provided herein are isolated antibodies, methods of making such antibodies, immunoconjugates and bispecific molecules comprising such antibodies, and pharmaceutical compositions formulated to contain the antibodies. Also provided herein are methods of using the antibodies for reducing tumor growth, alone or in combination with other therapeutic agents (e.g., antibodies) and/or cancer therapies. Accordingly, the anti-CD73 antibodies described herein may be used in a treatment in a wide variety of therapeutic applications, including, for example, inhibition of tumor growth, inhibition of metastasis, and enhancement of an immune response against a tumor.

Definitions

In order that the present description may be more readily understood, certain terms are first defined. Additional definitions are set forth throughout the detailed description.

The term "Cluster of Differentiation 73" or "CD73" as used herein refers to an enzyme (nucleotidase) capable of converting extracellular nucleoside 5' monophosphates to nucleosides, namely adenosine monophosphate (AMP) to adenosine. CD73 is usually found as a dimer anchored to the cell membrane through a glycosylphosphatidylinositol (GPI) linkage, has ecto-enzyme activity and plays a role in signal transduction. The primary function of CD73 is its conversion of extracellular nucleotides (e.g., 5'-AMP) to adenosine, a highly immunosuppressive molecule. Thus, ecto-5'-nucleotidase catalyzes the dephosphorylation of purine and pyrimidine ribo- and deoxyribonulceoside monophosphates to the corresponding nucleoside. Although CD73 has broad substrate specificity, it prefers purine ribonucleosides.

CD73 is also referred to as ecto-5'nuclease (ecto-5'NT, EC 3.1.3.5). The term "CD73" includes any variants or isoforms of CD73 which are naturally expressed by cells. Accordingly, antibodies described herein may cross-react with CD73 from species other than human (e.g., cynomolgus CD73). Alternatively, the antibodies may be specific for human CD73 and may not exhibit any cross-reactivity with other species. CD73 or any variants and isoforms thereof, may either be isolated from cells or tissues which naturally express them or be recombinantly produced using well-known techniques in the art and/or those described herein.

Two isoforms of human CD73 have been identified, both of which share the same N-terminal and C-terminal portions. Isoform 1 (Accession No. NP_002517.1; SEQ ID NO: 1) represents the longest protein, consisting of 574 amino acids and 9 exons. Isoform 2 (Accession No. NP_001191742.1; SEQ ID NO: 2) encodes a shorter protein, consisting of 524 amino acids, lacking amino acids 404-453. Isoform 2 lacks an alternate in-frame exon resulting in a transcript with only 8 exons, but with the same N- and C-terminal sequences.

The cynomolgus (cyno) CD73 protein sequence is provided as SEQ ID NO: 3. The terms cynomolgus and cyno both refer to the *Macaca fascicularis* species and are use interchangably throughout the specification.

The term "antibody" as used herein may include whole antibodies and any antigen binding fragments (i.e., "antigen-binding portions") or single chains thereof. An "antibody" refers, in one embodiment, to a glycoprotein comprising at least two heavy (H) chains and two light (L) chains interconnected by disulfide bonds, or an antigen binding portion thereof. Each heavy chain is comprised of a heavy chain variable region (abbreviated herein as $V_H$) and a heavy chain constant region. In certain naturally occurring IgG, IgD and IgA antibodies, the heavy chain constant region is comprised of three domains, CH1, CH2 and CH3. In certain naturally occurring antibodies, each light chain is comprised of a light chain variable region (abbreviated herein as $V_L$) and a light chain constant region. The light chain constant region is comprised of one domain, CL. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (C1q) of the classical complement system.

The heavy chain of an antibody may or may not contain a terminal lysine (K), or a terminal glycine and lysine (GK). Thus, any of the heavy chain sequences and heavy chain constant region sequences provided herein can end in either GK or G, or lack K or GK, regardless of what the last amino acid of the sequence provides. This is because the terminal lysine and sometimes glycine and lysine are cleaved during expression of the antibody.

Antibodies typically bind specifically to their cognate antigen with high affinity, reflected by a dissociation constant ($K_D$) of $10^{-7}$ to $10^{-11}$ M or less. Any $K_D$ greater than about $10^{-6}$ M is generally considered to indicate nonspecific binding. As used herein, an antibody that "binds specifically" to an antigen refers to an antibody that binds to the antigen and substantially identical antigens with high affinity, which means having a $K_D$ of $10^{-7}$ M or less, preferably $10^{-8}$ M or less, even more preferably $5 \times 10^{-9}$ M or less, and most preferably between $10^{-8}$ M and $10^{-10}$ M or less, but does not bind with high affinity to unrelated antigens. An antigen is "substantially identical" to a given antigen if it exhibits a high degree of sequence identity to the given antigen, for example, if it exhibits at least 80%, at least 90%, at least 95%, at least 97%, or at least 99% or greater sequence identity to the sequence of the given antigen. By way of example, an antibody that binds specifically to human CD73 may also cross-react with CD73 from certain non-human primate species (e.g., cynomolgus monkey), but may not cross-react with CD73 from other species, or with an antigen other than CD73.

An immunoglobulin may be from any of the commonly known isotypes, including but not limited to IgA, secretory IgA, IgG and IgM. The IgG isotype is divided in subclasses in certain species: IgG1, IgG2, IgG3 and IgG4 in humans, and IgG1, IgG2a, IgG2b and IgG3 in mice. In certain embodiments, the anti-CD73 antibodies described herein are of the human IgG1 or IgG2 subtype. Immunoglobulins, e.g., human IgG1, exist in several allotypes, which differ from each other in at most a few amino acids. "Antibody" may include, by way of example, both naturally occurring and non-naturally occurring antibodies; monoclonal and polyclonal antibodies; chimeric and humanized antibodies; human and nonhuman antibodies; wholly synthetic antibodies; and single chain antibodies.

The term "antigen-binding portion" of an antibody, as used herein, refers to one or more fragments of an antibody that retain the ability to specifically bind to an antigen (e.g., human CD73). It has been shown that the antigen-binding function of an antibody can be performed by fragments of a full-length antibody. Examples of binding fragments encompassed within the term "antigen-binding portion" of an antibody, e.g., an anti-CD73 antibody described herein, include (i) a Fab fragment, a monovalent fragment consisting of the $V_L$, $V_H$, CL and CH1 domains; (ii) a F(ab')$_2$ fragment, a bivalent fragment comprising two Fab fragments linked by a disulfide bridge at the hinge region; (iii) a Fd fragment consisting of the $V_H$ and CH1 domains; (iv) a Fv fragment consisting of the $V_L$ and $V_H$ domains of a single arm of an antibody, (v) a dAb fragment (Ward et al., (1989) *Nature* 341:544-546), which consists of a $V_H$ domain; and (vi) an isolated complementarity determining region (CDR) or (vii) a combination of two or more isolated CDRs which may optionally be joined by a synthetic linker. Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules known as single chain Fv (scFv); see e.g., Bird et al. (1988) *Science* 242:423-426; and Huston et al. (1988) *Proc. Natl. Acad. Sci. USA* 85:5879-5883). Such single chain antibodies are also intended to be encompassed within the term "antigen-binding portion" of an antibody. These and other potential constructs are described at Chan & Carter (2010) *Nat. Rev. Immunol.* 10:301. These antibody fragments are obtained using conventional techniques known to those with skill in the art, and the fragments are screened for utility in the same manner as are intact antibodies. Antigen-binding portions can be produced by recombinant DNA techniques, or by enzymatic or chemical cleavage of intact immunoglobulins.

A "bispecific" or "bifunctional antibody" is an artificial hybrid antibody having two different heavy/light chain pairs, giving rise to two antigen binding sites with specificity for different antigens. Bispecific antibodies can be produced by a variety of methods including fusion of hybridomas or linking of Fab' fragments. See, e.g., Songsivilai & Lachmann, *Clin. Exp. Immunol.* 79:315-321 (1990); Kostelny et al., *J. Immunol.* 148, 1547-1553 (1992).

The term "monoclonal antibody," as used herein, refers to an antibody that displays a single binding specificity and affinity for a particular epitope or a composition of antibodies in which all antibodies display a single binding specificity and affinity for a particular epitope. Typically such monoclonal antibodies will be derived from a single cell or nucleic acid encoding the antibody, and will be propagated without intentionally introducing any sequence alterations. Accordingly, the term "human monoclonal antibody" refers to a monoclonal antibody that has variable and optional constant regions derived from human germline immunoglobulin sequences. In one embodiment, human monoclonal antibodies are produced by a hybridoma, for example, obtained by fusing a B cell obtained from a transgenic or transchromosomal non-human animal (e.g., a transgenic mouse having a genome comprising a human heavy chain transgene and a light chain transgene), to an immortalized cell.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom, (b) antibodies isolated from a host cell transformed to express the antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies comprise variable and constant regions that utilize particular human germline immunoglobulin sequences and are encoded by the germline genes, but include subsequent rearrangements and mutations that occur, for example, during antibody maturation. As known in the art (see, e.g., Lonberg (2005) Nature Biotech. 23(9): 1117-1125), the variable region contains the antigen binding domain, which is encoded by various genes that rearrange to form an antibody specific for a foreign antigen. In addition to rearrangement, the variable region can be further modified by multiple single amino acid changes (referred to as somatic mutation or hypermutation) to increase the affinity of the antibody to the foreign antigen. The constant region will change in further response to an antigen (i.e., isotype switch). Therefore, the rearranged and somatically mutated nucleic acid sequences that encode the light chain and heavy chain immunoglobulin polypeptides in response to an antigen may not be identical to the original germline sequences, but instead will be substantially identical or similar (i.e., have at least 80% identity).

A "human" antibody (HuMAb) refers to an antibody having variable regions in which both the framework and CDR regions are derived from human germline immunoglobulin sequences. Furthermore, if the antibody contains a constant region, the constant region also is derived from human germline immunoglobulin sequences. The antibodies described herein may include amino acid residues not encoded by human germline immunoglobulin sequences (e.g., mutations introduced by random or site-specific mutagenesis in vitro or by somatic mutation in vivo). However, the term "human antibody", as used herein, is not intended to include antibodies in which CDR sequences derived from the germline of another mammalian species, such as a mouse, have been grafted onto human framework sequences. The terms "human" antibodies and "fully human" antibodies and are used synonymously.

A "humanized" antibody refers to an antibody in which some, most or all of the amino acids outside the CDR domains of a non-human antibody are replaced with corresponding amino acids derived from human immunoglobulins. In one embodiment of a humanized form of an antibody, some, most or all of the amino acids outside the CDR domains have been replaced with amino acids from human immunoglobulins, whereas some, most or all amino acids within one or more CDR regions are unchanged. Small additions, deletions, insertions, substitutions or modifications of amino acids are permissible as long as they do not abrogate the ability of the antibody to bind to a particular antigen. A "humanized" antibody retains an antigenic specificity similar to that of the original antibody.

A "chimeric antibody" refers to an antibody in which the variable regions are derived from one species and the constant regions are derived from another species, such as an antibody in which the variable regions are derived from a mouse antibody and the constant regions are derived from a human antibody.

A "modified heavy chain constant region" refers to a heavy chain constant region comprising the constant domains CH1, hinge, CH2, and CH3, wherein one or more of the constant domains are from a different isotype (e.g. IgG1, IgG2, IgG3, IgG4). In certain embodiments, the modified constant region includes a human IgG2 CH1 domain and a human IgG2 hinge fused to a human IgG1 CH2 domain and a human IgG1 CH3 domain. In certain embodiments, such modified constant regions also include amino acid modifications within one or more of the domains relative to the wildtype amino acid sequence.

When referring herein to an antibody as "CD73.3" or "CD73.4" without indicating the identity of the constant region, unless otherwise indicated, refers to antibodies having the variable regions of CD73.3 or CD73.4, respectively, with any constant region described herein.

As used herein, "isotype" refers to the antibody class (e.g., IgG1, IgG2, IgG3, IgG4, IgM, IgA1, IgA2, IgD, and IgE antibody) that is encoded by the heavy chain constant region genes.

"Allotype" refers to naturally occurring variants within a specific isotype group, which variants differ in a few amino acids (see, e.g., Jefferis et al. (2009) mAbs 1:1). Antibodies described herein may be of any allotype.

Unless specified otherwise herein, all amino acid numbers are according to the EU index of the Kabat system (Kabat, E. A., et al. (1991) Sequences of Proteins of Immunological Interest, Fifth Edition, U.S. Department of Health and Human Services, NIH Publication No. 91-3242).

The phrases "an antibody recognizing an antigen" and "an antibody specific for an antigen" are used interchangeably herein with the term "an antibody which binds specifically to an antigen."

An "isolated antibody," as used herein, is intended to refer to an antibody that is substantially free of other antibodies having different antigenic specificities (e.g., an isolated antibody that specifically binds to CD73 is substantially free of antibodies that specifically bind antigens other than CD73). An isolated antibody that specifically binds to an epitope of CD73 may, however, have cross-reactivity to other CD73 proteins from different species.

As used herein, an antibody that "inhibits CD73" refers to an antibody that inhibits a biological and/or enzymatic function of CD73. These functions include, for example, the ability of an antibody to inhibit CD73 enzymatic activity, e.g., CD73-regulated production of adenosine or reduction of cAMP production.

As used herein, an antibody that "internalizes" refers to an antibody that crosses the cell membrane upon binding to a cell-surface antigen. Internalization includes antibody mediated receptor, e.g., CD73, internalization. In some embodiments, the antibody "internalizes" into cells expressing CD73 at a rate of $T_{1/2}$ equal to about 10 min or less.

An "effector function" refers to the interaction of an antibody Fc region with an Fc receptor or ligand, or a biochemical event that results therefrom. Exemplary "effector functions" include C1q binding, complement dependent cytotoxicity (CDC), Fc receptor binding, FcγR-mediated effector functions such as ADCC and antibody dependent cell-mediated phagocytosis (ADCP), and downregulation of a cell surface receptor (e.g., the B cell receptor; BCR). Such effector functions generally require the Fc region to be combined with a binding domain (e.g., an antibody variable domain).

An "Fc receptor" or "FcR" is a receptor that binds to the Fc region of an immunoglobulin. FcRs that bind to an IgG antibody comprise receptors of the FcγR family, including allelic variants and alternatively spliced forms of these receptors. The FcγR family consists of three activating (FcγRI, FcγRIII, and FcγRIV in mice; FcγRIA, FcγRIIA, and FcγRIIIA in humans) and one inhibitory (FcγRIIB) receptor. Various properties of human FcγRs are summarized in Table 1. The majority of innate effector cell types coexpress one or more activating FcγR and the inhibitory FcγRIIB, whereas natural killer (NK) cells selectively express one activating Fc receptor (FcγRIII in mice and FcγRIIIA in humans) but not the inhibitory FcγRIIB in mice and humans. Human IgG1 binds to most human Fc receptors and is considered equivalent to murine IgG2a with respect to the types of activating Fc receptors that it binds to.

TABLE 1

Properties of human FcγRs

| Fcγ | Allelic variants | Affinity for human IgG | Isotype preference | Cellular distribution |
|---|---|---|---|---|
| FcγRI | None described | High ($K_D$ ~10 nM) | IgG1 = 3 > 4 >> 2 | Monocytes, macrophages, activated neutrophils, dentritic cells? |
| FcγRIIA | H131 | Low to medium | IgG1 > 3 > 2 > 4 | Neutrophils, monocytes, macrophages, eosinophils, dentritic cells, platelets |
| | R131 | Low | IgG1 > 3 > 4 > 2 | |

TABLE 1-continued

Properties of human FcγRs

| Fcγ | Allelic variants | Affinity for human IgG | Isotype preference | Cellular distribution |
|---|---|---|---|---|
| FcγRIIIA | V158 | Medium | IgG1 = 3 >> 4 > 2 | NK cells, monocytes, |
|  | F158 | Low | IgG1 = 3 >> 4 > 2 | macrophages, mast cells, eosinophils, dentritic cells? |
| FcγRIIB | I232 | Low | IgG1 = 3 = 4 > 2 | B cells, monocytes, |
|  | T232 | Low | IgG1 = 3 = 4 > 2 | macrophages, dentritic cells, mast cells |

A "hinge", "hinge domain" or "hinge region" or "antibody hinge region" refers to the domain of a heavy chain constant region that joins the CH1 domain to the CH2 domain and includes the upper, middle, and lower portions of the hinge (Roux et al. J. Immunol. 1998 161:4083). The hinge provides varying levels of flexibility between the binding and effector regions of an antibody and also provides sites for intermolecular disulfide bonding between the two heavy chain constant regions. As used herein, a hinge starts at Glu216 and ends at Gly237 for all IgG isotypes (Roux et al., 1998 J Immunol 161:4083). The sequences of wildtype IgG1, IgG2, IgG3 and IgG4 hinges are show in Tables 2 and 31.

the antibody to take form A or B (see, e.g., Allen et al. (2009) Biochemistry 48:3755). In certain embodiments, a hinge is a hybrid hinge that comprises sequences from at least two isotypes. For example, a hinge may comprise the upper, middle or lower hinge from one isotype and the remainder of the hinge from one or more other isotypes. For example, a hinge can be an IgG2/IgG1 hinge, and may comprise, e.g., the upper and middle hinges of IgG2 and the lower hinge of IgG1. A hinge may have effector function or be deprived of effector function. For example, the lower hinge of wildtype IgG1 provides effector function.

The term "CH1 domain" refers to the heavy chain constant region linking the variable domain to the hinge in a

TABLE 2

Hinge region amino acids

| Ig Type | C-terminal $C_H1$* (SEQ ID NO) | Upper Hinge (SEQ ID NO) | Middle Hinge (SEQ ID NO) | Lower Hinge (SEQ ID NO) |
|---|---|---|---|---|
| IgG1 | VDKRV (284) | EPKSCDKTHT (286) | CPPCP (290) | APELLGG (298) |
| IgG2 | VDKTV (285) | ERK | CCVECPPCP (291) | APPVAG (299) |
| IgG3 (17-15-15-15) | VDKRV (284) | ELKTPLGDTTHT (287) | CPRCP (EPKSCDTPPPCPRCP)$_3$ (292) | APELLGG (298) |
| IgG3 (17-15-15) | VDKRV (284) | ELKTPLGDTTHT (287) | CPRCP (EPKSCDTPPPCPRCP)$_2$ (293) | APELLGG (298) |
| IgG3 (17-15) | VDKRV (284) | ELKTPLGDTTHT (287) | CPRCP (EPKSCDTPPPCPRCP)$_1$ (294) | APELLGG (298) |
| IgG3 (15-15-15) | VDKRV (284) | EPKS (288) | CDTPPPCPRCP (EPKSCDTPPPCPRCP)$_2$ (295) | APELLGG (298) |
| IgG3 (15) | VDKRV (284) | EPKS (288) | CDTPPPCPRCP (296) | APELLGG (298) |
| IgG4 | VDKRV (284) | ESKYGPP (289) | CPSCP (297) | APEFLGG (298) |

*C-terminal amino acid sequences of the CH1 domains.

The term "hinge" includes wildtype hinges (such as those set forth in Tables 2 and 31), as well as variants thereof (e.g., non-naturally-occurring hinges or modified hinges). For example, the term "IgG2 hinge" includes wildtype IgG2 hinge, as shown in Table 2, and variants having 1, 2, 3, 4, 5, 1-3, 1-5, 3-5 and/or at most 5, 4, 3, 2, or 1 mutations, e.g., substitutions, deletions or additions. Exemplary IgG2 hinge variants include IgG2 hinges in which 1, 2, 3 or all 4 cysteines (C219, C220, C226 and C229) are changed to another amino acid. In a specific embodiment, an IgG2 comprises a C219S substitution. An IgG2 hinge may also comprise a substitution at C220 or substitutions at both C219 and a C220. An IgG2 hinge may comprise a substitution, which alone, or together with one or more substitutions in other regions of the heavy or light chain will cause heavy chain constant domain. As used herein, a CH1 domain starts at A118 and ends at V215. The term "CH1 domain" includes wildtype CH1 domains (such as having SEQ ID NO: 98 for IgG1 and SEQ ID NO: 124 for IgG2), as well as variants thereof (e.g., non-naturally-occurring CH1 domains or modified CH1 domains). For example, the term "CH1 domain" includes wildtype CH1 domains and variants thereof having 1, 2, 3, 4, 5, 1-3, 1-5, 3-5 and/or at most 5, 4, 3, 2, or 1 mutations, e.g., substitutions, deletions or additions. Exemplary CH1 domains include CH1 domains with mutations that modify a biological activity of an antibody, such as ADCC, CDC or half-life. Modifications to the CH1 domain that affect a biological activity of an antibody are provided herein. A CH1 domain may comprise the substitution C131S, which substitution may cause an IgG2 antibody or an antibody comprising at least a portion of an IgG2 antibody, such as the hinge and/or the hinge and CH1, to adopt the B form, as opposed to the A form of the antibody.

The term "CH2 domain" refers to the heavy chain constant region linking the hinge to the CH3 domain in a heavy chain constant domain. As used herein, a CH2 domain starts at P238 and ends at K340. The term "CH2 domain" includes wildtype CH2 domains (such as having SEQ ID NO: 137 for IgG1; Table 35), as well as variants thereof (e.g., non-naturally-occurring CH2 domains or modified CH2 domains). For example, the term "CH2 domain" includes wildtype CH2 domains and variants thereof having 1, 2, 3, 4, 5, 1-3, 1-5, 3-5 and/or at most 5, 4, 3, 2, or 1 mutations, e.g., substitutions, deletions or additions. Exemplary CH2 domains include CH2 domains with mutations that modify a biological activity of an antibody, such as ADCC, CDC or half-life. In certain embodiments, a CH2 domain comprises the substitutions A330S/P331S that reduce effector function. Other modifications to the CH2 domain that affect a biological activity of an antibody are provided herein.

The term "CH3 domain" refers to the heavy chain constant region that is C-terminal to the CH2 domain in a heavy chain constant domain. As used herein, a CH3 domain starts at G341 and ends at K447. The term "CH3 domain" includes wildtype CH3 domains (such as having SEQ ID NO: 138 for IgG1; Table 35), as well as variants thereof (e.g., non-naturally-occurring CH3 domains or modified CH3 domains). For example, the term "CH3 domain" includes wildtype CH3 domains and variants thereof having 1, 2, 3, 4, 5, 1-3, 1-5, 3-5 and/or at most 5, 4, 3, 2, or 1 mutations, e.g., substitutions, deletions or additions. Exemplary CH3 domains include CH3 domains with mutations that modify a biological activity of an antibody, such as ADCC, CDC or half-life. Modifications to the CH3 domain that affect a biological activity of an antibody are provided herein.

A "CL domain" refers to the constant domain of a light chain. The term "CL domain" includes wildtype CL domains and variants thereof, e.g., variants comprising C214S.

A "native sequence Fc region" or "native sequence Fc" comprises an amino acid sequence that is identical to the amino acid sequence of an Fc region found in nature. Native sequence human Fc regions include a native sequence human IgG1 Fc region; native sequence human IgG2 Fc region; native sequence human IgG3 Fc region; and native sequence human IgG4 Fc region as well as naturally occurring variants thereof. Native sequence Fc includes the various allotypes of Fcs (see, e.g., Jefferis et al. (2009) mAbs 1:1).

The term "epitope" or "antigenic determinant" refers to a site on an antigen (e.g., CD73) to which an immunoglobulin or antibody specifically binds. Epitopes within protein antigens can be formed both from contiguous amino acids (usually a linear epitope) or noncontiguous amino acids juxtaposed by tertiary folding of the protein (usually a conformational epitope). Epitopes formed from contiguous amino acids are typically, but not always, retained on exposure to denaturing solvents, whereas epitopes formed by tertiary folding are typically lost on treatment with denaturing solvents. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immunoprecipitation assays, wherein overlapping or contiguous peptides (e.g., from CD73) are tested for reactivity with a given antibody (e.g., anti-CD73 antibody). Methods of determining spatial conformation of epitopes include techniques in the art and those described herein, for example, x-ray crystallography, 2-dimensional nuclear magnetic resonance and HDX-MS (see, e.g., *Epitope Mapping Protocols in Methods in Molecular Biology*, Vol. 66, G. E. Morris, Ed. (1996)).

The term "epitope mapping" refers to the process of identification of the molecular determinants on the antigen involved in antibody-antigen recognition.

The term "binds to the same epitope" with reference to two or more antibodies means that the antibodies bind to the same segment of amino acid residues, as determined by a given method. Techniques for determining whether antibodies bind to the "same epitope on CD73" with the antibodies described herein include, for example, epitope mapping methods, such as, x-ray analyses of crystals of antigen: antibody complexes, which provides atomic resolution of the epitope, and hydrogen/deuterium exchange mass spectrometry (HDX-MS). Other methods that monitor the binding of the antibody to antigen fragments (e.g. proteolytic fragments) or to mutated variations of the antigen where loss of binding due to a modification of an amino acid residue within the antigen sequence is often considered an indication of an epitope component (e.g. alanine scanning mutagenesis—Cunningham & Wells (1985) *Science* 244:1081). In addition, computational combinatorial methods for epitope mapping can also be used. These methods rely on the ability of the antibody of interest to affinity isolate specific short peptides from combinatorial phage display peptide libraries.

Antibodies that "compete with another antibody for binding to a target" refer to antibodies that inhibit (partially or completely) the binding of the other antibody to the target. Whether two antibodies compete with each other for binding to a target, i.e., whether and to what extent one antibody inhibits the binding of the other antibody to a target, may be determined using known competition experiments, e.g., such as those described in the Examples. In certain embodiments, an antibody competes with, and inhibits binding of another antibody to a target by at least 10%, 20%, 30%, 40%, 50%, 60%, 70%, 80%, 90% or 100%. The level of inhibition or competition may be different depending on which antibody is the "blocking antibody" (i.e., the cold antibody that is incubated first with the target). Competition assays can be conducted as described, for example, in Ed Harlow and David Lane, Cold Spring Harb Protoc; 2006; doi:10.1101/pdb.prot4277 or in Chapter 11 of "Using Antibodies" by Ed Harlow and David Lane, Cold Spring Harbor Laboratory Press, Cold Spring Harbor, N.Y., USA 1999. Competing antibodies bind to the same epitope, an overlapping epitope or to adjacent epitopes (e.g., as evidenced by steric hindrance).

Other competitive binding assays include: solid phase direct or indirect radioimmunoassay (RIA), solid phase direct or indirect enzyme immunoassay (EIA), sandwich competition assay (see Stahli et al., *Methods in Enzymology* 9:242 (1983)); solid phase direct biotin-avidin EIA (see Kirkland et al., *J. Immunol.* 137:3614 (1986)); solid phase direct labeled assay, solid phase direct labeled sandwich assay (see Harlow and Lane, *Antibodies: A Laboratory Manual*, Cold Spring Harbor Press (1988)); solid phase direct label RIA using 1-125 label (see Morel et al., *Mol. Immunol.* 25(1):7 (1988)); solid phase direct biotin-avidin EIA (Cheung et al., *Virology* 176:546 (1990)); and direct labeled RIA. (Moldenhauer et al., *Scand. J. Immunol.* 32:77 (1990)).

As used herein, the terms "specific binding," "selective binding," "selectively binds," and "specifically binds," refer to antibody binding to an epitope on a predetermined antigen but not to other antigens. Typically, the antibody (i) binds with an equilibrium dissociation constant ($K_D$) of approximately less than $10^{-7}$ M, such as approximately less than $10^{-8}$ M, $10^{-9}$ M or $10^{-10}$ M or even lower when determined by, e.g., surface plasmon resonance (SPR) technology in a BIACORE® 2000 surface plasmon resonance instrument using the predetermined antigen, e.g., recombinant human CD73, as the analyte and the antibody as the ligand, or Scatchard analysis of binding of the antibody to antigen positive cells, and (ii) binds to the predetermined antigen with an affinity that is at least two-fold greater than its affinity for binding to a non-specific antigen (e.g., BSA, casein) other than the predetermined antigen or a closely-related antigen. Accordingly, unless otherwise indicated, an antibody that "specifically binds to human CD73" refers to an antibody that binds to soluble or cell bound human CD73 with a $K_D$ of $10^{-7}$ M or less, such as approximately less than $10^{-8}$ M, $10^{-9}$ M or $10^{-10}$ M or even lower. An antibody that "cross-reacts with cynomolgus CD73" refers to an antibody that binds to cynomolgus CD73 with a $K_D$ of $10^{-7}$ M or less, such as less than $10^{-8}$ M, $10^{-9}$ M or $10^{-10}$ M or even lower. In certain embodiments, antibodies that do not cross-react with CD73 from a non-human species exhibit essentially undetectable binding against these proteins in standard binding assays.

The term "$k_{assoc}$" or "$k_a$", as used herein, is intended to refer to the association rate constant of a particular antibody-antigen interaction, whereas the term "$k_{dis}$" or "$k_d$," as used herein, is intended to refer to the dissociation rate constant of a particular antibody-antigen interaction. The term "$K_D$", as used herein, is intended to refer to the equilibrium dissociation constant, which is obtained from the ratio of $k_d$ to $k_a$ (i.e., $k_d/k_a$) and is expressed as a molar concentration (M). $K_D$ values for antibodies can be determined using methods well established in the art. A preferred method for determining the $K_D$ of an antibody is by using surface plasmon resonance, preferably using a biosensor system such as a Biacore® surface plasmon resonance system or flow cytometry and Scatchard analysis.

The term "EC50" in the context of an in vitro or in vivo assay using an antibody or antigen binding fragment thereof, refers to the concentration of an antibody or an antigen-binding portion thereof that induces a response that is 50% of the maximal response, i.e., halfway between the maximal response and the baseline.

A "rate of internalization" of an antibody or of a receptor, e.g., CD73, as mediated by the antibody, e.g., an anti-CD73 antibody, may be represented, e.g., by $T_{1/2}$ of internalization, e.g., as shown in the Examples. A rate of internalization of an anti-CD73 antibody may be enhanced or increased by at least 10%, 30%, 50%, 75%, 2 fold, 3 fold, 5 fold or more, resulting in a reduction of the $T_{1/2}$ by at least 10%, 30%, 50%, 75%, 2 fold, 3 fold, 5 fold or more by changing the heavy chain constant region of the antibody to a modified heavy chain constant region, e.g., one that contains an IgG2 hinge and IgG2 CH1 domain. For example, instead of having a $T_{1/2}$ of 10 minutes, a modified heavy chain constant region may increase the rate of internalization and thereby reduce the $T_{1/2}$ to 5 minutes (i.e., a two fold increase in rate of internalization or a two-fold decrease in $T_{1/2}$). "$T_{1/2}$" is defined as the time at which half of the maximal internalization is achieved, as measured from the time the antibody is added to the cells. The maximal level of internalization can be the level of internalization at the plateau of a graph representing the internalization plotted against antibody concentrations. A modified heavy chain constant region may increase the maximal level of internalization of an antibody by at least 10%, 30%, 50%, 75%, 2 fold, 3 fold, 5 fold or more. Another way of comparing internalization efficacies of different antibodies, such as an antibody with, and the same antibody without, a modified heavy chain constant region, is by comparing their level of internalization at a given antibody concentration (e.g., 100 nM) or at a given time (e.g., 2 minutes, 5 minutes, 10 minutes or 30 minutes). Comparing levels of internalization can also be done by comparing the $EC_{50}$ levels of internatlization. The level of internalization of one antibody can be defined relative to that of a given (reference) antibody, e.g., an antibody described herein, e.g., 11F11 or CD73.4-IgG2CS-IgG1 or CD73.4-IgG2CS-IgG1.1f, and, can be indicated as a percentage of the value obtained with the given (reference) antibody. The extent of internalization may be enhanced by at least 10%, 30%, 50%, 75%, 2 fold, 3 fold, 5 fold or more, as compared by any one of these methods.

The term "naturally-occurring" as used herein as applied to an object refers to the fact that an object can be found in nature. For example, a polypeptide or polynucleotide sequence that is present in an organism (including viruses) that can be isolated from a source in nature and which has not been intentionally modified by man in the laboratory is naturally-occurring.

A "polypeptide" refers to a chain comprising at least two consecutively linked amino acid residues, with no upper limit on the length of the chain. One or more amino acid residues in the protein may contain a modification such as, but not limited to, glycosylation, phosphorylation or a disulfide bond. A "protein" may comprise one or more polypeptides.

The term "nucleic acid molecule," as used herein, is intended to include DNA molecules and RNA molecules. A nucleic acid molecule may be single-stranded or double-stranded, and may be cDNA.

Also provided are "conservative sequence modifications" of the sequences set forth in SEQ ID NOs described herein, i.e., nucleotide and amino acid sequence modifications which do not abrogate the binding of the antibody encoded by the nucleotide sequence or containing the amino acid sequence, to the antigen. Such conservative sequence modifications include conservative nucleotide and amino acid substitutions, as well as, nucleotide and amino acid additions and deletions. For example, modifications can be introduced into SEQ ID NOs described herein by standard techniques known in the art, such as site-directed mutagenesis and PCR-mediated mutagenesis. Conservative sequence modifications include conservative amino acid substitutions, in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, a predicted nonessential amino acid residue in an anti-CD73 antibody is preferably replaced with another amino acid residue from the same side chain family. Methods of identifying nucleotide and amino acid conservative substitutions that do not eliminate antigen binding are well-known in the art (see, e.g., Brummell et al., *Biochem.* 32:1180-1187

(1993); Kobayashi et al. *Protein Eng.* 12(10):879-884 (1999); and Burks et al. *Proc. Natl. Acad. Sci. USA* 94:412-417 (1997)).

Alternatively, in another embodiment, mutations can be introduced randomly along all or part of an anti-CD73 antibody coding sequence, such as by saturation mutagenesis, and the resulting modified anti-CD73 antibodies can be screened for improved binding activity.

For nucleic acids, the term "substantial homology" indicates that two nucleic acids, or designated sequences thereof, when optimally aligned and compared, are identical, with appropriate nucleotide insertions or deletions, in at least about 80% of the nucleotides, usually at least about 90% to 95%, and more preferably at least about 98% to 99.5% of the nucleotides. Alternatively, substantial homology exists when the segments will hybridize under selective hybridization conditions, to the complement of the strand.

For polypeptides, the term "substantial homology" indicates that two polypeptides, or designated sequences thereof, when optimally aligned and compared, are identical, with appropriate amino acid insertions or deletions, in at least about 80% of the amino acids, usually at least about 90% to 95%, and more preferably at least about 98% to 99.5% of the amino acids.

The percent identity between two sequences is a function of the number of identical positions shared by the sequences when the sequences are optimally aligned (i.e., % homology=# of identical positions/total # of positions×100), with optimal alignment determined taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two nucleotide sequences can be determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. The percent identity between two nucleotide or amino acid sequences can also be determined using the algorithm of E. Meyers and W. Miller (CABIOS, 4:11-17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. (48):444-453 (1970)) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6.

The nucleic acid and protein sequences described herein can further be used as a "query sequence" to perform a search against public databases to, for example, identify related sequences. Such searches can be performed using the NBLAST and XBLAST programs (version 2.0) of Altschul, et al. (1990) *J. Mol. Biol.* 215:403-10. BLAST nucleotide searches can be performed with the NBLAST program, score=100, wordlength=12 to obtain nucleotide sequences homologous to the nucleic acid molecules described herein. BLAST protein searches can be performed with the XBLAST program, score=50, wordlength=3 to obtain amino acid sequences homologous to the protein molecules described herein. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, the default parameters of the respective programs (e.g., XBLAST and NBLAST) can be used. See www.ncbi.nlm.nih.gov.

The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids (e.g., the other parts of the chromosome) or proteins, by standard techniques, including alkaline/SDS treatment, CsCl banding, column chromatography, agarose gel electrophoresis and others well known in the art. See, F. Ausubel, et al., ed. Current Protocols in Molecular Biology, Greene Publishing and Wiley Interscience, New York (1987).

Nucleic acids, e.g., cDNA, may be mutated, in accordance with standard techniques to provide gene sequences. For coding sequences, these mutations may affect amino acid sequence as desired. In particular, DNA sequences substantially homologous to or derived from native V, D, J, constant, switches and other such sequences described herein are contemplated.

The term "vector," as used herein, is intended to refer to a nucleic acid molecule capable of transporting another nucleic acid to which it has been linked. One type of vector is a "plasmid," which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors") In general, expression vectors of utility in recombinant DNA techniques are often in the form of plasmids. In the present specification, "plasmid" and "vector" may be used interchangeably as the plasmid is the most commonly used form of vector. However, also included are other forms of expression vectors, such as viral vectors (e.g., replication defective retroviruses, adenoviruses and adeno-associated viruses), which serve equivalent functions.

The term "recombinant host cell" (or simply "host cell"), as used herein, is intended to refer to a cell that comprises a nucleic acid that is not naturally present in the cell, and maybe a cell into which a recombinant expression vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

As used herein, the term "antigen" refers to any natural or synthetic immunogenic substance, such as a protein, peptide, or hapten. An antigen may be CD73 or a fragment thereof.

An "immune response" refers to a biological response within a vertebrate against foreign agents, which response protects the organism against these agents and diseases caused by them. An immune response is mediated by the action of a cell of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune response or reaction includes, e.g., activation or inhibition of a T cell, e.g., an effector T cell or a Th cell, such as a CD4+ or CD8+T cell, or the inhibition of a Treg cell.

An "immunomodulator" or "immunoregulator" refers to an agent, e.g., a component of a signaling pathway, which may be involved in modulating, regulating, or modifying an immune response. "Modulating," "regulating," or "modifying" an immune response refers to any alteration in a cell of the immune system or in the activity of such cell (e.g., an effector T cell). Such modulation includes stimulation or suppression of the immune system which may be manifested by an increase or decrease in the number of various cell types, an increase or decrease in the activity of these cells, or any other changes which can occur within the immune system. Both inhibitory and stimulatory immunomodulators have been identified, some of which may have enhanced function in a tumor microenvironment. The immunomodulator may be located on the surface of a T cell. An "immunomodulatory target" or "immunoregulatory target" is an immunomodulator that is targeted for binding by, and whose activity is altered by the binding of, a substance, agent, moiety, compound or molecule. Immunomodulatory targets include, for example, receptors on the surface of a cell ("immunomodulatory receptors") and receptor ligands ("immunomodulatory ligands").

An increased ability to stimulate an immune response, or the immune system, can result from an enhanced agonist activity of T cell costimulatory receptors and/or an enhanced antagonist activity of inhibitory receptors. An increased ability to stimulate an immune response or the immune system may be reflected by a fold increase of the EC50 or maximal level of activity in an assay that measures an immune response, e.g., an assay that measures changes in cytokine or chemokine release, cytolytic activity (determined directly on target cells or indirectly via detecting CD107a or granzymes) and proliferation. The ability to stimulate an immune response or the immune system activity may be enhanced by at least 10%, 30%, 50%, 75%, 2 fold, 3 fold, 5 fold or more.

"Immunotherapy" refers to the treatment of a subject afflicted with, or at risk of contracting or suffering a recurrence of, a disease by a method comprising inducing, enhancing, suppressing or otherwise modifying an immune response.

"Immunostimulating therapy" or "immunostimulatory therapy" refers to a therapy that results in increasing (inducing or enhancing) an immune response in a subject for, e.g., treating cancer.

"Potentiating an endogenous immune response" means increasing the effectiveness or potency of an existing immune response in a subject. This increase in effectiveness and potency may be achieved, for example, by overcoming mechanisms that suppress the endogenous host immune response or by stimulating mechanisms that enhance the endogenous host immune response.

"T effector" ("$T_{eff}$") cells refers to T cells (e.g., CD4+ and CD8+T cells) with cytolytic activities as well as T helper (Th) cells, which secrete cytokines and activate and direct other immune cells, but does not include regulatory T cells (Treg cells).

As used herein, the term "linked" refers to the association of two or more molecules. The linkage can be covalent or non-covalent. The linkage also can be genetic (i.e., recombinantly fused). Such linkages can be achieved using a wide variety of art recognized techniques, such as chemical conjugation and recombinant protein production.

As used herein, "administering" refers to the physical introduction of a composition comprising a therapeutic agent to a subject, using any of the various methods and delivery systems known to those skilled in the art. Preferred routes of administration for antibodies described herein include intravenous, intraperitoneal, intramuscular, subcutaneous, spinal or other parenteral routes of administration, for example by injection or infusion. The phrase "parenteral administration" as used herein means modes of administration other than enteral and topical administration, usually by injection, and includes, without limitation, intravenous, intraperitoneal, intramuscular, intraarterial, intrathecal, intralymphatic, intralesional, intracapsular, intraorbital, intracardiac, intradermal, transtracheal, subcutaneous, subcuticular, intraarticular, subcapsular, subarachnoid, intraspinal, epidural and intrasternal injection and infusion, as well as in vivo electroporation. Alternatively, an antibody described herein can be administered via a non-parenteral route, such as a topical, epidermal or mucosal route of administration, for example, intranasally, orally, vaginally, rectally, sublingually or topically. Administering can also be performed, for example, once, a plurality of times, and/or over one or more extended periods.

As used herein, the term "T cell-mediated response" refers to a response mediated by T cells, including effector T cells (e.g., $CD8^+$ cells) and helper T cells (e.g., $CD4^+$ cells). T cell mediated responses include, for example, T cell cytotoxicity and proliferation.

As used herein, the term "cytotoxic T lymphocyte (CTL) response" refers to an immune response induced by cytotoxic T cells. CTL responses are mediated primarily by $CD8^+$ T cells.

As used herein, the terms "inhibits" or "blocks" (e.g., referring to inhibition/blocking of CD73 binding or activity) are used interchangeably and encompass both partial and complete inhibition/blocking.

As used herein, "cancer" refers a broad group of diseases characterized by the uncontrolled growth of abnormal cells in the body. Unregulated cell division may result in the formation of malignant tumors or cells that invade neighboring tissues and may metastasize to distant parts of the body through the lymphatic system or bloodstream.

The terms "treat," "treating," and "treatment," as used herein, refer to any type of intervention or process performed on, or administering an active agent to, the subject with the objective of reversing, alleviating, ameliorating, inhibiting, or slowing down or preventing the progression, development, severity or recurrence of a symptom, complication, condition or biochemical indicia associated with a disease. Prophylaxis refers to administration to a subject who does not have a disease, to prevent the disease from occurring or minimize its effects if it does.

A "hematological malignancy" includes a lymphoma, leukemia, myeloma or a lymphoid malignancy, as well as a cancer of the spleen and the lymph nodes. Exemplary lymphomas include both B cell lymphomas and T cell lymphomas. B-cell lymphomas include both Hodgkin's lymphomas and most non-Hodgkin's lymphomas. Non-limiting examples of B cell lymphomas include diffuse large B-cell lymphoma, follicular lymphoma, mucosa-associated lymphatic tissue lymphoma, small cell lymphocytic lymphoma (overlaps with chronic lymphocytic leukemia), mantle cell lymphoma (MCL), Burkitt's lymphoma, mediastinal large B cell lymphoma, Waldenström macroglobulinemia, nodal marginal zone B cell lymphoma, splenic marginal zone lymphoma, intravascular large B-cell lymphoma, primary effusion lymphoma, lymphomatoid granulomatosis. Non-limiting examples of T cell lymphomas include extranodal T cell lymphoma, cutaneous T cell lymphomas, anaplastic large cell lymphoma, and angioimmunoblastic T cell lymphoma. Hematological malignancies also include leukemia, such as, but not limited to, secondary leukemia, chronic lymphocytic leukemia, acute myelogenous leukemia, chronic myelogenous leukemia, and acute lymphoblastic leukemia. Hematological malignancies further include myelomas, such as, but not limited to, multiple myeloma and smoldering multiple myeloma. Other hematological and/or B cell- or T-cell-associated cancers are encompassed by the term hematological malignancy.

The term "effective dose" or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A "prophylactically effective amount" or a "prophylactically effective dosage" of a drug is an amount of the drug that, when administered alone or in combination with another therapeutic agent to a subject at risk of developing a disease or of suffering a recurrence of disease, inhibits the development or recurrence of the disease. The ability of a therapeutic or prophylactic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

By way of example, an anti-cancer agent is a drug that slows cancer progression or promotes cancer regression in a subject. In preferred embodiments, a therapeutically effective amount of the drug promotes cancer regression to the point of eliminating the cancer. "Promoting cancer regression" means that administering an effective amount of the drug, alone or in combination with an anti-neoplastic agent, results in a reduction in tumor growth or size, necrosis of the tumor, a decrease in severity of at least one disease symptom, an increase in frequency and duration of disease symptom-free periods, a prevention of impairment or disability due to the disease affliction, or otherwise amelioration of disease symptoms in the patient. Pharmacological effectiveness refers to the ability of the drug to promote cancer regression in the patient. Physiological safety refers to an acceptably low level of toxicity, or other adverse physiological effects at the cellular, organ and/or organism level (adverse effects) resulting from administration of the drug.

By way of example for the treatment of tumors, a therapeutically effective amount or dosage of the drug preferably inhibits cell growth or tumor growth by at least about 20%, more preferably by at least about 40%, even more preferably by at least about 60%, and still more preferably by at least about 80% relative to untreated subjects. In the most preferred embodiments, a therapeutically effective amount or dosage of the drug completely inhibits cell growth or tumor growth, i.e., preferably inhibits cell growth or tumor growth by 100%. The ability of a compound to inhibit tumor growth can be evaluated using the assays described infra. Alternatively, this property of a composition can be evaluated by examining the ability of the compound to inhibit cell growth, such inhibition can be measured in vitro by assays known to the skilled practitioner. In other preferred embodiments described herein, tumor regression may be observed and may continue for a period of at least about 20 days, more preferably at least about 40 days, or even more preferably at least about 60 days.

The terms "patient" and "subject" refer to any human or non-human animal that receives either prophylactic or therapeutic treatment. For example, the methods and compositions described herein can be used to treat a subject having cancer. The term "non-human animal" includes all vertebrates, e.g., mammals and non-mammals, such as non-human primates, sheep, dog, cow, chickens, amphibians, reptiles, etc.

Various aspects described herein are described in further detail in the following subsections.

I. Anti-CD73 Antibodies

Described herein are antibodies, e.g., fully human antibodies, which are characterized by particular functional features or properties. For example, the antibodies specifically bind human CD73. Additionally, antibodies may cross react with CD73 from one or more non-human primates, such as cynomolgus CD73.

In addition to binding specifically to soluble and/or membrane bound human CD73, the antibodies described herein exhibit one or more of the following functional properties:

(a) inhibition of CD73 enzymatic activity, resulting in a reduction of adenosine produced;

(b) binding to cyno CD73;

(c) antibody mediated CD73 internalization into cells, e.g., tumor cells; and (d) binding to a conformational epitope comprising amino acids 65-83 and 157-172 of human CD73.

Preferably, anti-CD73 antibodies bind to human CD73 (monomeric or dimeric; isoform 1 or 2) with high affinity, for example, with a $K_D$ of $10^{-7}$ M or less, $10^{-8}$ M or less, $10^{-9}$ M or less, $10^{-10}$ M or less, $10^{-11}$ M or less, $10^{-12}$ M or less, $10^{-12}$ M to $10^{-7}$ M, $10^{-11}$ M to $10^{-7}$ M, $10^{-10}$ M to $10^{-7}$ M, $10^{-9}$ M to $10^{-7}$ M, or $10^{-10}$ M to $10^{-8}$ M. In certain embodiments, an anti-CD73 antibody binds to soluble human CD73, e.g, as determined by BIACORE® SPR analysis, with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-7}$ M, $10^{-10}$ M to $10^{-7}$ M, $10^{-9}$ M to $10^{-7}$ M, $10^{-8}$ M to $10^{-7}$ M or $10^{-10}$ M to $10^{-8}$ M. In certain embodiments, an anti-CD73 antibody binds to bound (e.g., cell membrane bound, e.g., Calu6 cells) human CD73, e.g., as determined as further described herein, with an EC50 of less than 1 nM. In certain embodiments, an anti-CD73 antibody binds to bound human CD73, e.g., cell membrane bound human CD73, e.g., as determined by flow cytometry and Scatchard plot, with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, $10^{-10}$ M to $10^{-8}$ M, or $10^{-10}$ M to $10^{-9}$ M. In certain embodiments, an anti-CD73 antibody binds to soluble human CD73 with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-7}$ M, $10^{-10}$ M to $10^{-7}$ M, $10^{-9}$ M to $10^{-7}$ M, $10^{-10}$ M to $10^{-8}$ M, or $10^{-8}$ M to $10^{-7}$ M, and to bound human CD73, e.g., cell membrane bound human CD73, with a $K_D$ or $EC_{50}$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M.

In certain embodiments, an anti-CD73 antibody binds to cyno CD73 with high affinity, e.g., it binds to a CHO cell expressing cyno CD73 with an EC50 of 0.1 nM to 10 nM, such as an EC50 of less than 1 nM, as determined, e.g., as further described herein.

In certain embodiments, anti-CD73 antibodies described herein also bind to cynomolgus CD73, e.g., bind to membrane bound cynomolgus CD73, e.g, to a CHO cell expressing cyno CD73 with an $EC_{50}$ of 100 nM or less, 10 nM or less, 1 nM or less, 100 nM to 0.01 nM, 100 nM to 0.1 nM, 100 nM to 1 nM, or 10 nM to 0.1 nM, as measured, e.g., in the Examples.

In certain embodiments, anti-CD73 antibodies are at least 90%, 95%, 98%, or 99% monomeric, as determined, e.g., by SEC. Anti-CD73 antibodies may also have biophysical characteristics that are similar to, or within the range of, those of the antibodies described herein.

In certain embodiments, anti-CD73 antibodies inhibit the enzymatic activity of human and/or cyno CD73, e.g., as determined in CD73 bead bound assays, or as determined in cells, e.g., Calu6, SKMEL24 or H292 cells, or as determined in an in vivo assay, e.g., a xenograft tumor model, e.g., as further described in the Examples. Anti-CD73 antibodies may have inhibitory activities that are at least similar to, or within the range of, those of the antibodies described herein. For example, anti-CD73 antibodies may inhibit human CD73 (e.g., CD73 bound to a solid) enzymatic activity (adenosine production) with an $EC_{50}$ of less than 10 nM or less than 5 nM or in the range of 1 to 10 nM or 5 to 10 nM. Anti-CD73 antibodies may inhibit the activity of human CD73 on cells, e.g., Calu6 cells with an $EC_{50}$ of less than 10 nM or less than 1 nM or in the range of 0.1 to 10 nM, 0.1 to 1 nM or 0.1 to 0.5 nM.

In certain embodiments, anti-CD73 antibodies are internalized (and mediate CD73 internalization) by a cell to which it binds as determined, e.g., in a high content internalization assay or by FACS or flow cytometry, as further described in the Examples. Anti-CD73 antibodies may have internalization characteristics (EC50, $T_{1/2}$ and Ymax), and time to plateau that are at least similar to, or within the range of, those of the antibodies described in the Examples. In certain embodiments, an anti-CD73 antibody has a $T_{1/2}$ of internalization that is less than 1 hour, such as less than 30 minutes, less than 15 minutes, less than 12 minutes, less than 10 minutes, less than 7 minutes or even less than 5 minutes in one or more cell lines, e.g, those set forth in the Examples, as determined, e.g., in a high content internalization assay (described in Example 6A). In certain embodiments, an anti-CD73 antibody reaches maximal anti-CD73 antibody mediated internalization within 10 hours or less, 6 hours or less, 5 hours or less, 4 hours or less, 3 hours or less, 2 hours or less, 1 hour or less, e.g., in the range of 10 minutes to 10 hours, 10 minutes to 6 hours, 1 hour to 10 hours or 1 hour to 6 hours, as determined, e.g., using a high content internalization assay, as described, e.g., in Example 6A, or using flow cytometry, as described, e.g., in Example 6B. The maximal level of anti-CD73 antibody mediated internalization of CD73 may be at least 50%, at least 60%, at least 70%, at least 80%, at least 90% or more, depending on the cell type. For example, the $EC_{50}$ of anti-CD73 antibody mediated internalization of CD73 in Calu6 cells, as measured in the high content internalization assay described in the Examples, may be less than 10 nM, e.g., from 0.1 to 10 nM or 1 to 10 nM or 1 to 5 nM and a Ymax of at least 90% or at least 95%.

Anti-CD73 antibodies, e.g., antibodies having an IgG2 hinge, IgG2 CH1 domain, or IgG2 hinge and IgG2 CH1 domain, may mediate the following CD73 internalization characteristics as measured in a high content internalization assay, e.g., as described in Example 6A:

$EC_{50}$ of 10 nM or less, 5 nM or less, 1 nM or less, or 0.1 to 10 nM or 0.1 to 1 nM; a Ymax (maximal percentage of internalization) of at least 90%, 95% or 98% in Calu6 cells and a $T_{1/2}$ of less than 30 minutes or less than 10 minutes in Calu6 cells;

A T½ of less than 30 minutes or less than 10 minutes in human cells, e.g., Calu6 cells, HCC44 cells, H2030 cells, H2228 cells, HCC15 cells, SKLU1 cells, SKMES1 cells or SW900 cells.

Anti-CD73 antibodies, e.g., antibodies having an IgG2 hinge, IgG2 CH1 domain, or IgG2 hinge and IgG2 CH1 domain, may mediate the following CD73 internalization characteristics as measured by flow cytometry, e.g., as described in Example 6B:

A $T_{1/2}$ of 1 hour or less and a Ymax of at least 70% in Calu6 cells;

A $T_{1/2}$ of 30 minutes or less and a Ymax of at least 70% in NCI-H292 cells;

A $T_{1/2}$ of 2 hours or less and a Ymax of at least 30% in SNUC1 cells; and/or A $T_{1/2}$ of 30 minutes or less and a Ymax of at least 60% in NCI-H1437 cells.

In certain embodiments, an anti-CD73 antibody is a bin1 antibody, i.e., it competes for binding to human CD73 with 11F11, but not with 4C3.

In certain embodiments, anti-CD73 antibodies bind to an epitope, e.g., a conformational epitope in the N-terminal portion of human CD73, e.g., an epitope located within amino acids 65-83 of human CD73 (SEQ ID NO:96), as determined, e.g., by HDX-MS, as further described in the Examples. In certain embodiments, anti-CD73 antibodies bind to amino acids 157-172 of human CD73 (SEQ ID NO: 97), or to an epitope located within amino acids 157-172, of human CD73 (SEQ ID NO: 97), as determined, e.g., by HDX-MS. Alternatively, anti-CD73 antibodies bind to an epitope, e.g., a discontinuous epitope in the N-terminal portion of human CD73, as determined, e.g., by HDX-MS.

In certain embodiments, anti-CD73 antibodies bind to amino acids 65 to 83 and amino acids 157-172 of human CD73, or to an epitope within amino acids 65 to 83 and amino acids 157-172, of human CD73 isoform 1 or 2, i.e., amino acid sequences FTKVQQIRRAEPNVLLLDA (SEQ ID NO: 96) and LYLPYKVLPVGDEVVG (SEQ ID NO: 97), as determined by, e.g., HDX-MS. In certain embodiments, the anti-CD73 antibodies bind to all or a portion of amino acids 65 to 83 and amino acids 157-172 of human CD73, as determined by, e.g., HDX-MS. In certain embodiments, anti-CD73 antibodies bind to both glycosylated and unglycosylated human CD73. In certain embodiments, anti-CD73 antibodies bind only to glycosylated CD73 and not to unglycosylated CD73.

Anti-CD73 antibodies may compete for binding to CD73 with (or inhibit binding of) anti-CD73 antibodies comprising CDRs or variable regions described herein, e.g., those of CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11. In certain embodiments, anti-CD73 antibodies inhibit binding of CD73.4-1, CD73.4-2, CD73.3, 11F11, 4C3, 4D4, 10D2, 11A6, 24H2, 5F8, 6E11 and/or 7A11 to human CD73 by at least 10%, 20%, 30%, 40%, 50%, 60%, 70%, 80%, 90% or by 100%. In certain embodiments, CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11 inhibit binding of anti-CD73 antibodies to human CD73 by at least 10%, 20%, 30%, 40%, 50%, 60%, 70%, 80%, 90% or by 100%. In certain embodiments, anti-CD73 antibodies inhibit binding of CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11 to human CD73 by at least 10%, 20%, 30%, 40%, 50%, 60%, 70%, 80%, 90% or by 100% and CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11 inhibit binding of the anti-CD73 antibodies to human CD73 by at least 10%, 20%, 30%, 40%, 50%, 60%, 70%, 80%, 90% or by 100% (e.g., compete in both directions). Competition experiments may be performed, e.g., as further described herein, e.g., in the Examples.

In certain embodiments, anti-CD73 antibodies inhibit CD73 enzymatic activity and/or are internalized in cells without requiring multivalent cross-linking, as determined, e.g., by the lack of requirement of FcR binding.

In certain embodiments, anti-CD73 antibodies have 1, 2, 3, 4, 5, 6, 7, 8, 9, 10, or 11 of the features listed in Table 3.

TABLE 3

Potential features of anti-CD73 antibodies (1) binding to human CD73, e.g., bead bound human monomeric and dimeric human CD73 isoform 1 and 2, e.g., with a $K_D$ of 10 nM or less (e.g., 0.01 nM to 10 nM), e.g., as measured by BIACORE ® SPR analysis;

(2) binding to membrane bound human CD73, e.g., with an $EC_{50}$ of 1 nM or less (e.g., 0.01 nM to 1 nM);

(3) binding to cynomolgus CD73, e.g., binding to membrane bound cynomolgus CD73, e.g, with an $EC_{50}$ of 10 nM or less (e.g., 0.01 nM to 10 nM);

(4) inhibition of human CD73 enzymatic activity, e.g., with an EC50 of 10 nM or less;

(5) inhibition of cyno CD73 enzymatic activity, e.g., with an EC50 of 10 nM or less;

(6) inhibition of endogenous (cellular) human CD73 enzymatic activity in Calu6 cells with an EC50 of 10 nM or less;

(7) inhibition of human CD73 enzymatic activity in vivo;

(8) internalization, e.g., antibody mediated (or dependent) CD73 internalization, into cells, e.g., with a $T_{1/2}$ of less than 1 hour, 30 minutes or 10 minutes and/or a Ymax of at least 70%, 80% or 90%;

(9) binding to a conformational epitope on human CD73, e.g., a discontinuous epitope within the TABLE 3-continued Potential features of anti-CD73 antibodies amino acid sequence (SEQ ID NO: 1) which includes all or a portion of amino acid residues FTKVQQIRRAEPNVLLLDA (SEQ ID NO: 96) and/or LYLPYKVLPVGDEVVG (SEQ ID NO: 97);

(10) competing in either direction or both directions for binding to human CD73 with CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11; and

(11) interacting with human CD73 in a similar pattern as CD73.4, as determined by X-ray crystallography.

An antibody activity that exhibits one or more of these functional properties (e.g., biochemical, immunochemical, cellular, physiological or other biological activities, or the like) as determined according to methodologies known to the art and described herein, will be understood to relate to a statistically significant difference in the particular activity relative to that seen in the absence of the antibody (e.g., or when a control antibody of irrelevant specificity is present). In certain embodiments, an anti-CD73 antibody disclosed herein decreases a measured parameter (e.g., tumor volume, tumor metastasis, adenosine levels, cAMP levels) by at least 10% of the measured parameter, more preferably by at least 20%, 30%, 40%, 50%, 60%, 70%, 80% or 90%, and in certain preferred embodiments, by greater than 92%, 94%, 95%, 97%, 98% or 99%. Conversely, an anti-CD73 antibody disclosed herein increases a measured parameter by at least 10%, such as by at least 20%, 30%, 40%, 50%, 60%, 70%, 80%, 90%, 95%, 100% (i.e. 2 fold), 3 fold, 5 fold, or 10 fold.

Standard assays to evaluate the binding ability of the antibodies toward CD73 of various species are known in the art, including for example, ELISAs, Western blots, and RIAs. Suitable assays are described in detail in the Examples. The binding kinetics (e.g., binding affinity) of the antibodies also can be assessed by standard assays known in the art, such as by BIACORE® SPR analysis. Assays to evaluate the effects of the antibodies on functional properties of CD73 (e.g., adenosine production, tumor growth and metastasis, T cell inhibition) are described in further detail infra and in the Examples.

In certain embodiments, anti-CD73 antibodies are not native antibodies or are not naturally-occurring antibodies. For example, anti-CD73 antibodies have post-translational modifications that are different from those of antibodies that are naturally occurring, such as by having more, less or a different type of post-translational modification.

In certain embodiments, anti-CD73 antibodies stimulate Teff (T effector) function and/or reduce Treg function, e.g., by removing CD73 from the T cell surface and/or by inhibiting its enzymatic activity.

In certain embodiments, anti-CD3 antibodies comprise at least an IgG2 hinge, and optionally also an IgG2 CH1 domain or fragment or derivative of the hinge and/or CH1 domain and the antibody form A (see, e.g., Allen et al. (2009) Biochemistry 48:3755). In certain embodiments, anti-CD3 antibodies comprise at least an IgG2 hinge, and optionally also an IgG2 CH1 domain or fragment or derivative of the hinge and/or CH1 domain and the antibody has adopted form B (see, e.g., Allen et al. (2009) Biochemistry 48:3755).

In certain embodiments a composition comprises a mixture of anti-CD73 antibodies with form A and anti-CD73 antibodies with form B.

Provided herein are anti-human CD73 antibodies that (i) comprise a variable region that binds to a region on human CD73 that is similar to that bound by 11F11, but does not bind to a region that is similar to that bound by 4C3 (i.e., is a bin1 antibody); (ii) bind to monomeric and dimeric human CD73 with a Kd of 10 nM or less; (iii) inhibit the enzymatic activity (conversion of AMP to adenosine) of human CD73, e.g., on cells, e.g., Calu6 cells, with an $EC_{50}$ of less than 10 nM; and (iv) mediate antibody dependent CD73 internalization in cells, e.g., with a T½ of 1 hour or less (or 30 minutes or less, or 10 minutes or less), a Ymax of 50% or more (or 60% or more, 70% or more, 80% or more or 90% or more) in human cells, e.g., Calu6 cells, H2228 cells, HCC15 cells H2030 cells, SNUC1 cells. In certain embodiments, the antibodies comprise an IgG2 hinge or an IgG2 hinge and IgG2 CH1 domain. Provided herein are anti-human CD73 antibodies that (i) comprise a variable region that binds to a region on human CD73 that is similar to that bound by 11F11, but does not bind to a region that is similar to that bound by 4C3 (i.e., is a bin1 antibody); (ii) bind to monomeric and dimeric human CD73 with a Kd of 10 nM or less, as determined by SPR (Biacore); (iii) inhibit the enzymatic activity (conversion of AMP to adenosine) of human CD73, e.g., on cells, e.g., Calu6 cells, with an $EC_{50}$ of less than 10 nM; and (iv) mediate antibody dependent CD73 internalization in cells, e.g., with a T½ of 30 minutes or less, a Ymax of 80% or more in human Calu6, H2228, HCC15 or H2030 cells, as determined using the high content internalization assay described in Example 6A.

In preferred embodiments, an anti-CD73 antibody described herein is not significantly toxic. For example, an anti-CD73 antibody is not significantly toxic to an organ of a human, e.g., one or more of the liver, kidney, brain, lungs, and heart, as determined, e.g., in clinical trials. In certain embodiments, an anti-CD73 antibody does not significantly trigger an undesirable immune response, e.g., autoimmunity or inflammation.

II. Exemplary Anti-CD73 Antibodies

Variable Regions of Anti-CD73 Antibodies

Particular antibodies described herein are antibodies, e.g., monoclonal antibodies, having the CDR and/or variable region sequences of antibodies 11F11-1, 11F11-2, 4C3-1, 4C3-2, 4C3-3, 4D4, 10D2-1, 10D2-2, 11A6, 24H2, 5F8-1, 5F8-2, 6E11, 7A11, CD73.3-1, -2 or -3, CD73.4-1 and -2, CD73.4-2, CD73.5-1 and -2, CD73.6-1 and -2, CD73.7-1 and -2, CD73.8-1 and -2, CD73.9-1 and -2, CD73.10-1 and -2 and CD73.11, as well as antibodies having at least 80% identity (e.g., at least 85%, at least 90%, at least 95%, or at least 99% identity) to their variable region or CDR sequences. Table 4 sets forth the SEQ ID NOs of the CDRs of the VH and VL regions of each antibody, as well as that of the VH and VL regions. As further described in the Examples, certain heavy chains can exist with more than one light chain, and the SEQ ID NOs of the alternate light chains are also provided in the Table below.

TABLE 4

|  | VH | | | | VL | | | |
| --- | --- | --- | --- | --- | --- | --- | --- | --- |
|  | CDR1 | CDR2 | CDR3 | VH | CDR1 | CDR2 | CDR3 | VL |
| 11F11-1 | 5 | 6 | 7 | 4 | 9 | 10 | 11 | 8 |
| 11F11-2 | 5 | 6 | 7 | 4 | 13 | 14 | 15 | 12 |

TABLE 4-continued

|  | VH | | | | VL | | | |
| --- | --- | --- | --- | --- | --- | --- | --- | --- |
|  | CDR1 | CDR2 | CDR3 | VH | CDR1 | CDR2 | CDR3 | VL |
| 4C3-1 | 17 | 18 | 19 | 16 | 21 | 22 | 23 | 20 |
| 4C3-2 | 17 | 18 | 19 | 16 | 25 | 26 | 27 | 24 |
| 4C3-3 | 17 | 18 | 19 | 16 | 29 | 30 | 31 | 28 |
| 4D4-1 | 33 | 34 | 35 | 32 | 37 | 38 | 39 | 36 |
| 10D2-1 | 41 | 42 | 43 | 40 | 45 | 46 | 47 | 44 |
| 10D2-2 | 41 | 42 | 43 | 40 | 49 | 50 | 51 | 48 |
| 11A6-1 | 53 | 54 | 55 | 52 | 57 | 58 | 59 | 56 |
| 24H2-1 | 61 | 62 | 63 | 60 | 65 | 66 | 67 | 64 |
| 5F8-1 | 69 | 70 | 71 | 68 | 73 | 74 | 75 | 72 |
| 5F8-2 | 69 | 70 | 71 | 68 | 77 | 78 | 79 | 76 |
| 5F8-3 | 69 | 70 | 71 | 68 | 239 | 240 | 241 | 238 |
| 6E11-1 | 81 | 82 | 83 | 80 | 85 | 86 | 87 | 84 |
| 7A11-1 | 89 | 90 | 91 | 88 | 93 | 94 | 95 | 92 |
| 73.3 | 17 | 18 | 19 | 170 | 21 | 22 | 23 | 20 |
| 73.4-1 | 5 | 6 | 7 | 135 | 9 | 10 | 11 | 8 |
| 73.4-2 | 5 | 6 | 7 | 135 | 13 | 14 | 15 | 12 |
| 73.5-1 | 5 | 6 | 7 | 171 | 9 | 10 | 11 | 8 |
| 73.5-2 | 5 | 6 | 7 | 171 | 13 | 14 | 15 | 12 |
| 73.6-1 | 5 | 6 | 7 | 172 | 9 | 10 | 11 | 8 |
| 73.6-2 | 5 | 6 | 7 | 172 | 13 | 14 | 15 | 12 |
| 73.7-1 | 5 | 6 | 7 | 173 | 9 | 10 | 11 | 8 |
| 73.7-2 | 5 | 6 | 7 | 173 | 13 | 14 | 15 | 12 |
| 73.8-1 | 5 | 6 | 7 | 174 | 9 | 10 | 11 | 8 |
| 73.8-2 | 5 | 6 | 7 | 174 | 13 | 14 | 15 | 12 |
| 73.9-1 | 5 | 6 | 7 | 175 | 9 | 10 | 11 | 8 |
| 73.9-2 | 5 | 6 | 7 | 175 | 13 | 14 | 15 | 12 |
| 73.10-1 | 5 | 6 | 7 | 176 | 9 | 10 | 11 | 8 |
| 73.10-2 | 5 | 6 | 7 | 176 | 13 | 14 | 15 | 12 |
| 73.11 | 33 | 34 | 35 | 177 | 37 | 38 | 39 | 36 |

Provided herein are isolated antibodies, or antigen binding portion thereof, comprising heavy and light chain variable regions, wherein the heavy chain variable region comprises an amino acid sequence selected from the group consisting of SEQ ID NOs: 4, 16, 32, 40, 52, 60, 68, 80, 88, 135, and 170-177.

Also provided are isolated antibodies, or antigen binding portions thereof, comprising heavy and light chain variable regions, wherein the light chain variable region comprises an amino acid sequence selected from the group consisting of SEQ ID NOs: 8, 12, 20, 24, 28, 36, 44, 48, 56, 64, 72, 76, 84, 92 and 238.

Provided herein are isolated antibodies, or antigen-binding portion thereof, comprising:

(a) heavy and light chain variable region sequences comprising SEQ ID NOs: 135 and 8, respectively;

(b) heavy and light chain variable region sequences comprising SEQ ID NOs: 135 and 12, respectively;

(c) heavy and light chain variable region sequences comprising SEQ ID NOs: 4 and 8, respectively;

(d) heavy and light chain variable region sequences comprising SEQ ID NOs: 4 and 12, respectively;

(e) heavy and light chain variable region sequences comprising SEQ ID NOs: 16 and 20, respectively;

(f) heavy and light chain variable region sequences comprising SEQ ID NOs: 16 and 24, respectively;

(g) heavy and light chain variable region sequences comprising SEQ ID NOs: 16 and 28, respectively;

(h) heavy and light chain variable region sequences comprising SEQ ID NOs: 32 and 36, respectively;

(i) heavy and light chain variable region sequences comprising SEQ ID NOs: 40 and 44, respectively;

(j) heavy and light chain variable region sequences comprising SEQ ID NOs: 40 and 48, respectively;

(k) heavy and light chain variable region sequences comprising SEQ ID NOs: 52 and 56, respectively;

(l) heavy and light chain variable region sequences comprising SEQ ID NOs: 60 and 64, respectively;

(m) heavy and light chain variable region sequences comprising SEQ ID NOs: 68 and 72, respectively;

(n) heavy and light chain variable region sequences comprising SEQ ID NOs: 68 and 76, respectively;

(o) heavy and light chain variable region sequences comprising SEQ ID NOs: 68 and 238, respectively;

(p) heavy and light chain variable region sequences comprising SEQ ID NOs: 80 and 84, respectively;

(q) heavy and light chain variable region sequences comprising SEQ ID NOs: 88 and 92, respectively;

(r) heavy and light chain variable region sequences comprising SEQ ID NOs: 170 and 20, respectively;

(s) heavy and light chain variable region sequences comprising SEQ ID NOs: 170 and 24, respectively;

(t) heavy and light chain variable region sequences comprising SEQ ID NOs: 170 and 28, respectively;

(u) heavy and light chain variable region sequences comprising SEQ ID NOs: 171 and 8, respectively;

(v) heavy and light chain variable region sequences comprising SEQ ID NOs: 171 and 12, respectively;

(w) heavy and light chain variable region sequences comprising SEQ ID NOs: 172 and 8, respectively;

(x) heavy and light chain variable region sequences comprising SEQ ID NOs: 172 and 12, respectively;

(y) heavy and light chain variable region sequences comprising SEQ ID NOs: 173 and 8, respectively;

(z) heavy and light chain variable region sequences comprising SEQ ID NOs: 173 and 12, respectively;

(a2) heavy and light chain variable region sequences comprising SEQ ID NOs: 174 and 8, respectively;

(b2) heavy and light chain variable region sequences comprising SEQ ID NOs: 174 and 12, respectively;

(c2) heavy and light chain variable region sequences comprising SEQ ID NOs: 175 and 8, respectively;

(d2) heavy and light chain variable region sequences comprising SEQ ID NOs: 175 and 12, respectively;

(e2) heavy and light chain variable region sequences comprising SEQ ID NOs: 176 and 8, respectively;

(f2) heavy and light chain variable region sequences comprising SEQ ID NOs: 176 and 12, respectively; or (g2) heavy and light chain variable region sequences comprising SEQ ID NOs: 177 and 36, respectively.

Anti-CD73 antibodies may comprise the heavy and light chain CDR1s, CDR2s and CDR3s of anti-CD73 antibodies described herein, e.g., CD73.4-1, CD73.4-2, CD73.3, 11F11-1, 11F11-2, 11F11, 4C3-1, 4C3-2, 4C3-3, 4D4, 10D2-1, 10D2-2, 11A6, 24H2, 5F8-1, 5F8-2, 5F8-3, 6E11 and 7A11, or combinations thereof.

Given that each of these antibodies binds to CD73 and that antigen-binding specificity is provided primarily by the CDR1, 2 and 3 regions, the $V_H$ CDR1, 2 and 3 sequences and $V_L$ CDR1, 2 and 3 sequences can be "mixed and matched" (i.e., CDRs from different antibodies can be mixed and match, although each antibody must contain a $V_H$ CDR1, 2 and 3 and a $V_L$ CDR1, 2 and 3) to create other anti-CD73 binding molecules described herein. CD73 binding of such "mixed and matched" antibodies can be tested using the binding assays described above and in the Examples (e.g., ELISAs). Preferably, when $V_H$ CDR sequences are mixed and matched, the CDR1, CDR2 and/or CDR3 sequence from a particular $V_H$ sequence is replaced with a structurally similar CDR sequence(s). Likewise, when $V_L$ CDR sequences are mixed and matched, the CDR1, CDR2 and/or CDR3 sequence from a particular $V_L$ sequence preferably is replaced with a structurally similar CDR sequence(s). It will be readily apparent to the ordinarily skilled artisan that novel $V_H$ and $V_L$ sequences can be created by substituting one or more $V_H$ and/or $V_L$ CDR region sequences with structurally similar sequences from the CDR sequences disclosed herein for monoclonal antibodies CD73.4-1, CD73.4-2, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11. "Mixed and matched" antibodies having binding affinity, bioactivity and/or other properties equivalent or superior to the specific antibodies disclosed herein may be selected for use in the methods of the present invention.

Provided herein are isolated antibodies, or antigen binding portion thereof comprising:

(a) a heavy chain variable region CDR1 comprising an amino acid sequence selected from the group consisting of SEQ ID NOs: 5, 17, 33, 41, 53, 61, 69, 81, and 89;

(b) a heavy chain variable region CDR2 comprising an amino acid sequence selected from the group consisting of SEQ ID NOs: 6, 18, 34, 42, 54, 62, 70, 82, and 90;

(c) a heavy chain variable region CDR3 comprising an amino acid sequence selected from the group consisting of SEQ ID NOs: 7, 19, 35, 43, 55, 63, 71, 83, and 91;

(d) a light chain variable region CDR1 comprising an amino acid sequence selected from the group consisting of SEQ ID NOs: 9, 13, 21, 25, 29, 37, 45, 49, 57, 65, 73, 77, 85, and 93;

(e) a light chain variable region CDR2 comprising an amino acid sequence selected from the group consisting of SEQ ID NOs: 10, 14, 22, 26, 30, 38, 46, 50, 58, 66, 74, 78, 86, and 94; and (f) a light chain variable region CDR3 comprising an amino acid sequence selected from the group consisting of SEQ ID NOs: 11, 15, 23, 27, 31, 39, 47, 51, 59, 67, 75, 79, 87, and 95;

wherein the antibody specifically binds to human CD73.

In certain embodiments, the antibody comprises heavy and light chain variable regions, wherein the heavy chain variable region CDR1, CDR2, and CDR3 regions comprise SEQ ID NOs: 5-7; 17-19; 33-35; 41-43; 53-55; 61-63; 69-71; 81-83; or 89-91;

wherein the antibody specifically binds to human CD73.

In certain embodiments, the antibody comprises heavy and light chain variable regions, wherein the light chain variable region CDR1, CDR2, and CDR3 regions comprise:

(a) SEQ ID NOs: 9-11; 13-15; 21-23; 25-27; 29-31; 37-39; 45-47; 49-51; 57-59; 65-67; 73-75; 77-79; 85-87; or 93-95;

wherein the antibody specifically binds to human CD73.

In certain embodiments, the antibody comprises heavy and light chain variable regions, wherein:

(a) the heavy chain variable region CDR1, CDR2, and CDR3 comprises SEQ ID NOs: 5-7, respectively, and the light chain variable region CDR1, CDR2, and CDR3 comprises SEQ ID NOs: 9-11, respectively;

(b) the heavy chain variable region CDR1, CDR2, and CDR3 comprises SEQ ID NOs: 5-7, respectively, and the light chain variable region CDR1, CDR2, and CDR3 comprises SEQ ID NOs: 13-15, respectively;

(c) the heavy chain variable region CDR1, CDR2, and CDR3 comprises SEQ ID NOs: 17-19, respectively, and the light chain variable region CDR1, CDR2, and CDR3 comprises SEQ ID NOs: 21-23, respectively;

(d) the heavy chain variable region CDR1, CDR2, and CDR3 comprises SEQ ID NOs: 17-19, respectively, and the light chain variable region CDR1, CDR2, and CDR3 comprises SEQ ID NOs: 25-27, respectively;

(e) the heavy chain variable region CDR1, CDR2, and CDR3 comprises SEQ ID NOs: 17-19, respectively, and the light chain variable region CDR1, CDR2, and CDR3 comprises SEQ ID NOs: 29-31, respectively;

(f) the heavy chain variable region CDR1, CDR2, and CDR3 comprises SEQ ID NOs: 33-35, respectively, and the light chain variable region CDR1, CDR2, and CDR3 comprises SEQ ID NOs: 37-39, respectively;

(g) the heavy chain variable region CDR1, CDR2, and CDR3 comprises SEQ ID NOs: 41-43, respectively, and the light chain variable region CDR1, CDR2, and CDR3 comprises SEQ ID NOs: 45-47, respectively;

(h) the heavy chain variable region CDR1, CDR2, and CDR3 comprises SEQ ID NOs: 41-43, respectively, and the light chain variable region CDR1, CDR2, and CDR3 comprises SEQ ID NOs: 49-51, respectively;

(i) the heavy chain variable region CDR1, CDR2, and CDR3 comprises SEQ ID NOs: 53-55, respectively, and the light chain variable region CDR1, CDR2, and CDR3 comprises SEQ ID NOs: 57-59, respectively;

(j) the heavy chain variable region CDR1, CDR2, and CDR3 comprises SEQ ID NOs: 61-63, respectively, and the light chain variable region CDR1, CDR2, and CDR3 comprises SEQ ID NOs: 65-67, respectively;

(k) the heavy chain variable region CDR1, CDR2, and CDR3 comprises SEQ ID NOs: 69-71, respectively, and the light chain variable region CDR1, CDR2, and CDR3 comprises SEQ ID NOs: 73-75, respectively;

(l) the heavy chain variable region CDR1, CDR2, and CDR3 comprises SEQ ID NOs: 69-71, respectively, and the light chain variable region CDR1, CDR2, and CDR3 comprises SEQ ID NOs: 77-79, respectively;

(m) the heavy chain variable region CDR1, CDR2, and CDR3 comprises SEQ ID NOs: 81-83, respectively, and the light chain variable region CDR1, CDR2, and CDR3 comprises SEQ ID NOs: 85-87, respectively; or (n) the heavy chain variable region CDR1, CDR2, and CDR3 comprises SEQ ID NOs: 89-91, respectively, and the light chain variable region CDR1, CDR2, and CDR3 comprises SEQ ID NOs: 93-95, respectively;

wherein the antibody specifically binds to human CD73, and optionally has one or more of the characteristics listed in Table 3, e.g., the ability to inhibit dephosphorylation of AMP and to mediate receptor dependent CD73 internalization.

In certain embodiments, the antibody comprises heavy and light chain variable regions, wherein:

(a) the heavy chain variable region CDR1, CDR2, and CDR3 consist of SEQ ID NOs: 5-7, respectively, and the light chain variable region CDR1, CDR2, and CDR3 consist of SEQ ID NOs: 9-11, respectively;

(b) the heavy chain variable region CDR1, CDR2, and CDR3 consist of SEQ ID NOs: 5-7, respectively, and the light chain variable region CDR1, CDR2, and CDR3 consist of SEQ ID NOs: 13-15, respectively;

(c) the heavy chain variable region CDR1, CDR2, and CDR3 consist of SEQ ID NOs: 17-19, respectively, and the light chain variable region CDR1, CDR2, and CDR3 consist of SEQ ID NOs: 21-23, respectively;

(d) the heavy chain variable region CDR1, CDR2, and CDR3 consist of SEQ ID NOs: 17-19, respectively, and the light chain variable region CDR1, CDR2, and CDR3 consist of SEQ ID NOs: 25-27, respectively;

(e) the heavy chain variable region CDR1, CDR2, and CDR3 consist of SEQ ID NOs: 17-19, respectively, and the light chain variable region CDR1, CDR2, and CDR3 consist of SEQ ID NOs: 29-31, respectively;

(f) the heavy chain variable region CDR1, CDR2, and CDR3 consist of SEQ ID NOs: 33-35, respectively, and the light chain variable region CDR1, CDR2, and CDR3 consist of SEQ ID NOs: 37-39, respectively;

(g) the heavy chain variable region CDR1, CDR2, and CDR3 consist of SEQ ID NOs: 41-43, respectively, and the light chain variable region CDR1, CDR2, and CDR3 consist of SEQ ID NOs: 45-47, respectively;

(h) the heavy chain variable region CDR1, CDR2, and CDR3 consist of SEQ ID NOs: 41-43, respectively, and the light chain variable region CDR1, CDR2, and CDR3 consist of SEQ ID NOs: 49-51, respectively;

(i) the heavy chain variable region CDR1, CDR2, and CDR3 consist of SEQ ID NOs: 53-55, respectively, and the light chain variable region CDR1, CDR2, and CDR3 consist of SEQ ID NOs: 57-59, respectively;

(j) the heavy chain variable region CDR1, CDR2, and CDR3 consist of SEQ ID NOs: 61-63, respectively, and the light chain variable region CDR1, CDR2, and CDR3 consist of SEQ ID NOs: 65-67, respectively;

(k) the heavy chain variable region CDR1, CDR2, and CDR3 consist of SEQ ID NOs: 69-71, respectively, and the light chain variable region CDR1, CDR2, and CDR3 consist of SEQ ID NOs: 73-75, respectively;

(l) the heavy chain variable region CDR1, CDR2, and CDR3 consist of SEQ ID NOs: 69-71, respectively, and the light chain variable region CDR1, CDR2, and CDR3 consist of SEQ ID NOs: 77-79, respectively;

(m) the heavy chain variable region CDR1, CDR2, and CDR3 consist of SEQ ID NOs: 81-83, respectively, and the light chain variable region CDR1, CDR2, and CDR3 consist of SEQ ID NOs: 85-87, respectively; or (n) the heavy chain variable region CDR1, CDR2, and CDR3 consist of SEQ ID NOs: 89-91, respectively, and the light chain variable region CDR1, CDR2, and CDR3 consist of SEQ ID NOs: 93-95, respectively;

wherein the antibody specifically binds to human CD73, and optionally has one or more of the characteristics listed in Table 3, e.g., the ability to inhibit dephosphorylation of AMP and to mediate receptor dependent CD73 internalization.

Heavy Chain Constant Domains of Anti-CD73 Antibodies

The heavy chain constant region of anti-CD73 antibodies described herein may be of any isotype, e.g., IgG1, IgG2, IgG3 and IgG4, or combinations thereof and/or modifications thereof. An anti-CD73 antibody may have effector function or may have reduced or no effector function. In certain embodiments, anti-CD73 antibodies described herein comprise a modified heavy chain constant region that provides enhanced properties to the antibody. As shown in the Examples, anti-CD73 antibodies having an IgG2 hinge and optionally an IgG2 CH1 domain, such as those having the variable regions of the 11F11 antibody, are better and faster internalized relative to antibodies having the same variable region but with a non-IgG2 hinge or CH1, e.g., relative to antibodies having an IgG1 hinge or an IgG1 hinge and IgG1 CH1. For example an antibody comprising the variable regions of the 11F11 antibody and comprising an IgG2 hinge and optionally an IgG2 CH1 and an IgG1 CH2 and IgG1 CH3 domains, and whether with or without effector function, is more efficiently internalized into cells upon binding to CD73 on the cell membrane relative to the same antibody, but with an IgG1 hinge or an IgG1 hinge and IgG1 CH1 domain. As further shown herein, a CD73 antibody having an IgG2 hinge and the remainder of the antibody of an IgG1 isotype internalizes more efficiently than the same antibody wherein the hinge is of an IgG1 isotype. An antibody having, in addition to an IgG2 hinge, an IgG2 CH1 domain internalizes even more efficiently than the same antibody in which the CH1 domain is an IgG1 CH1 domain. As further shown herein, anti-CD73 antibodies with an IgG2 hinge and optionally IgG2 CH1 also form larger antibody/antigen complexes than antibodies having an IgG1 hinge or IgG1 hinge and IgG1 CH1. Increased internalization appears to correlate with increased antibody/antigen complex size. As further described in the Examples, enhanced internalization does not appear to be associated with a higher or lower affinity of the antibody. Accordingly, provided herein are anti-CD73 antibodies having a modified heavy chain constant region that mediates antibody mediated CD73 internalization, and wherein the antibody with the modified heavy chain constant region binds to CD73 with a similar affinity as the same antibody, but with a different heavy chain constant region.

In certain embodiments, a CD73 antibody comprises a modified heavy chain constant region that comprises a hinge of the IgG2 isotype (an "IgG2 hinge") and a CH1, CH2 and CH3 domain. In certain embodiments, a modified heavy chain constant region comprises an IgG2 hinge and a CH1, CH2 and CH3 domain, wherein at least one of the CH1, CH2 and CH3 domains is not of the IgG2 isotype. In certain embodiments, a modified heavy chain constant region comprises a hinge of the IgG2 isotype, a CH1 of the IgG2 isotype, wherein at least one of the CH2 and CH3 domains is not of the IgG2 isotype. The IgG2 hinge may be a wildtype IgG2 hinge, e.g., a wildtype human IgG2 hinge (e.g., having SEQ ID NO:136) or a variant thereof, provided that the IgG2 hinge retains the ability to confer to the antibody an enhanced activity (e.g., increased internalization by a cell; enhanced inhibition of enzymatic activity; increased antagonist or blocking activity; the ability to form large antibody/antigen cross-linked complexes; increased ability to stimulate or enhance an immune response; and/or increased anti-proliferative or anti-tumor effect) relative to that of the same antibody that comprises a non-IgG2 hinge and optionally a non-IgG2 CH1 domain. In certain embodiments, an IgG2 hinge variant retains similar rigidity or stiffness to that of a wildtype IgG2 hinge. The rigidity of a hinge or an antibody can be determined, e.g., by computer modeling, electron microscopy, spectroscopy such as Nuclear Magnetic Resonance (NMR), X-ray crystallography (B-factors), or Sedimentation Velocity Analytical ultracentrifugation (AUC) to measure or compare the radius of gyration of antibodies comprising the hinge. A hinge or antibody may have similar or higher rigidity relative to another hinge if an antibody comprising the hinge has a value obtained from one of the tests described in the previous sentence that differs from the value of the same antibody with a different hinge, e.g., an IgG1 hinge, in less than 5%, 10%, 25%, 50%, 75%, or 100%. A person of skill in the art would be able to determine from the tests whether a hinge or an antibody has at least similar rigidity to that of another hinge or antibody, respectively, by interpreting the results of these tests. An exemplary human IgG2 hinge variant is an IgG2 hinge that comprises a substitution of one or more of the four cysteine residues (i.e., C219, C220, C226 and C229) with another amino acid. A cysteine may be replaced by a serine. An exemplary IgG2 hinge is a human IgG2 hinge comprising a C219X mutation or a C220X mutation, wherein X is any amino acid except serine. In a certain embodiments, an IgG2 hinge does not comprise both a C219X and a C220X substitution. In certain embodiments, an IgG2 hinge comprises C219S or C220S, but not both C219S and C220S. Other IgG2 hinge variants that may be used include human IgG2 hinges comprising a C220, C226 and/or C229 substitution, e.g., a C220S, C226S or C229S mutation (which may be combined with a C219S mutation). An IgG2 hinge may also be an IgG2 hinge in which a portion of the hinge is that of another isotype (i.e., it is a chimeric or hybrid hinge), provided that the rigidity of the chimeric hinge is at least similar to that of a wildtype IgG2 hinge. For example, an IgG2 hinge may be an IgG2 hinge in which the lower hinge (as defined in Table 2) is of an IgG1 isotype, and is, e.g., a wildtype IgG1 lower hinge.

A "hybrid" or "chimeric" hinge is referred to as being of a specific isotype if more than half of the consecutive amino acids of the hinge are from that isotype. For example, a hinge having an upper and middle hinge of IgG2 and the lower hinge of IgG1 is considered to be an IgG2 hybrid hinge.

In certain embodiments, a CD73 antibody comprises a modified heavy chain constant region that comprises an IgG2 hinge comprising one of the following hinges:

| | |
|---|---|
| ERKCCVECPPCPAPPVAG; | (SEQ ID NO: 348) |
| ERKSCVECPPCPAPPVAG; | (SEQ ID NO: 349) |
| ERKCSVECPPCPAPPVAG; | (SEQ ID NO: 350) |
| ERKXCVECPPCPAPPVAG; | (SEQ ID NO: 351) |
| ERKCXVECPPCPAPPVAG; | (SEQ ID NO: 352) |
| ERKCCVECPPCPAPPVAGX; | (SEQ ID NO: 353) |
| ERKSCVECPPCPAPPVAGX; | (SEQ ID NO: 354) |
| ERKCSVECPPCPAPPVAGX; | (SEQ ID NO: 355) |
| ERKXCVECPPCPAPPVAGX; | (SEQ ID NO: 356) |
| ERKCXVECPPCPAPPVAGX; | (SEQ ID NO: 357) |
| ERKCCVECPPCPAPELLGG; | (SEQ ID NO: 358) |
| ERKSCVECPPCPAPELLGG; | (SEQ ID NO: 359) |
| ERKCCSVECPPCPAPELLGG; | (SEQ ID NO: 360) |
| ERKXCVECPPCPAPELLGG; | (SEQ ID NO: 361) |
| ERKCXVECPPCPAPELLGG; | (SEQ ID NO: 362) |
| ERKCCVECPPCPAPELLG; | (SEQ ID NO: 363) |
| ERKSCVECPPCPAPELLG; | (SEQ ID NO: 364) |
| ERKCCSVECPPCPAPELLG; | (SEQ ID NO: 365) |
| ERKXCVECPPCPAPELLG; | (SEQ ID NO: 366) |
| ERKCXVECPPCPAPELLG; | (SEQ ID NO: 367) |
| ERKCCVECPPCPAP; | (SEQ ID NO: 368) |
| ERKSCVECPPCPAP; | (SEQ ID NO: 369) |
| ERKCSVECPPCPAP; | (SEQ ID NO: 370) |
| ERKXCVECPPCPAP;<br>or | (SEQ ID NO: 371) |
| ERKCXVECPPCPAP, | (SEQ ID NO: 372) | wherein X is any amino acid, except a cysteine, or any of the above sequences, in which 1-5, 1-3, 1-2 or 1 amino acid is inserted between amino acid residues CVE and CPP. In certain embodiments, THT or GGG is inserted.

In certain embodiments, the hinge comprises SEQ ID NO: 348, 349, 350, 351, or 352, wherein 1, 2, 3 or all 4 amino acids P233, V234, A235 and G237 (corresponding to the C-terminal 4 amino acids "PVAG" (SEQ ID NO: 373) are deleted or substituted with another amino acid, e.g., the amino acids of the C-terminus of the IgG1 hinge (ELLG (SEQ ID NO: 374) or ELLGG (SEQ ID NO: 375)). In certain embodiments, the hinge comprises SEQ ID NO: 348, 349, 350, 351, or 352, wherein V234, A235 and G237 are deleted or substituted with another amino acid. In certain embodiments, the hinge comprises SEQ ID NO: 348, 349, 350, 351, or 352, wherein A235 and G237 are deleted or substituted with another amino acid. In certain embodiments, the hinge comprises SEQ ID NO: 348, 349, 350, 351, or 352, wherein G237 is deleted or substituted with another amino acid. In certain embodiments, the hinge comprises SEQ ID NO: 348, 349, 350, 351, or 352, wherein V234 and A235 are deleted or substituted with another amino acid. Substitution of PVAG (SEQ ID NO: 373) in an IgG2 with the corresponding amino acids of an IgG1 hinge, i.e., (ELLG (SEQ ID NO: 374) or ELLGG (SEQ ID NO: 375)) to obtain a hybrid hinge, e.g., shown above, provides a hinge having the advantages of an IgG2 hinge and the effector function of IgG1 hinges.

In certain embodiments, a modified heavy chain constant region comprises a hinge that consists of or consists essentially of one of the sequences shown above, e.g., any one of SEQ ID NOs: 348-372, and e.g., does not comprise additional hinge amino acid residues.

In certain embodiments, 1 or 1-2 or 1-3 amino acids are inserted between the hinge and CH2 domain, e.g., an additional glycine may be added.

In certain embodiments an anti-CD73 antibody comprises a modified heavy chain constant region comprising an IgG1 or IgG2 constant region, wherein the hinge comprises a deletion of 1-10 amino acids. As shown in the Examples, an IgG1 antibody lacking amino acid residues SCDKTHT (S219, C220, D221, K222, T223, H224 and T225; SEQ ID NO: 376) conferred antibody mediated CD73 internalization more effectively than the same antibody having a wildtype IgG1 constant region. Similarly, in the context of an IgG2 antibody, an IgG2 antibody lacking amino acid residues CCVE (C219, C220, V222, and E224; SEQ ID NO: 377) conferred antibody mediated CD73 internalization more effectively than the same antibody having a wildtype IgG1 constant region. Accordingly, provided herein are modified heavy chain constant region in which the hinge comprises a deletion of 1, 2, 3, 4, 5, 6, or 7 amino acid residues, selected from residues S219, C220, D221, K222, T223, H224 and T225 for an IgG1 antibody, and residues C219, C220, V222, and E224 for an IgG2 antibody.

In certain embodiments, a modified heavy chain constant region comprises a CH1 domain that is a wildtype CH1 domain of the IgG1 or IgG2 isotype ("IgG1 CH1 domain" or "IgG2 CH1 domain," respectively). CH1 domains of the isotypes IgG3 and IgG4 ("IgG3 CH1 domain" and "IgG2 CH1 domain," respectively) may also be used. A CH1 domain may also be a variant of a wildtype CH1 domain, e.g., a variant of a wildtype IgG1, IgG2, IgG3 or IgG4 CH1 domain. Exemplary variants of CH1 domains include A114C, T173C and/or C131, e.g., C131S.

A CH1 domain, e.g., an IgG2 CH1 domain, may comprise the substitution C131S, which substitution confers onto an IgG2 antibody or antibody having an IgG2 CH1 and hinge the B form (or conformation).

In certain embodiments, a modified heavy chain constant region comprises a CH1 domain that is of the IgG2 isotype. In certain embodiments, the CH1 domain is wildtype IgG2 CH1 domain, e.g., having the amino acid sequence: AST-KGPSVFPLAPCSRSTS ESTAALGCLVKDYFPEPVTVSWNSGALTSGVHT FPAVLQSS GLYSLSSVVTVPSS NFGTQTYTCNVDHKPSNTKVDKTV (SEQ ID NO: 378). In certain embodiments, the CH1 domain is a variant of SEQ ID NO: 378 and comprises 1-10, 1-5, 1-2 or 1 amino acid substitutions or deletions relative to SEQ ID NO: 378. As further described in the Examples, it has been shown herein that an IgG2 CH1 domain or variants thereof confer enhanced or altered internalization properties to anti-CD73 antibodies relative to IgG1 antibodies and even more enhanced or altered internalization when the antibodies also comprise an IgG2 hinge. In certain embodiments, IgG2 CH1 variants do not comprise an amino acid substitution or deletion at one or more of the following amino acid residues: C131, R133, E137 and S138, which amino acid residues are shown in bold and underlined in SEQ ID NO: 378 shown above. For example, a modified heavy chain constant region may comprise an IgG2 CH1 domain in which neither of R133, E137 and S138 are substituted with another amino acid or are deleted or in which neither of C131, R133, E137 and S138 are substituted with another amino acid or are deleted. In certain embodiments, C131 is substituted with another amino acid, e.g., C131S, which substitution triggers the antibody to adopt conformation B. Both conformation A and conformation B antibodies having modified heavy chain constant regions have been shown herein to have enhanced activities relative to the same antibody with an IgG1 constant region.

In certain embodiments, N192 and/or F193 (shown as italicized and underlined residues in SEQ ID NO: 378 shown above) are substituted with another amino acid, e.g., with the corresponding amino acids in IgG1, i.e., N192S and/or F193L.

In certain embodiments, one or more amino acid residues of an IgG2 CH1 domain are substituted with the corresponding amino acid residues in IgG4. For example, N192 may be N192S; F193 may be F193L; C131 may be C131K; and/or T214 may be T214R.

An antibody may comprise a modified heavy chain constant region comprising an IgG2 CH1 domain or variant thereof and IgG2 hinge or variant thereof. The hinge and CH1 domain may be a combination of any IgG2 hinge and IgG2 CH1 domain described herein. In certain embodiments, the IgG2 CH1 and hinge comprise the following amino acid sequence ASTKGPSVFPLAPCSRSTS ESTAALGCLVKDYFPEPVTVSWNSGALTSG VHTF-PAVLQSS GLYSLSSVVTVPSS NFGTQTYTCNVDHKPSNTKVDKTV ERKCCVECPPCPAPPVAG (SEQ ID NO: 379), or an amino acid sequence that differs therefrom in at most 1-10 amino acids. The amino acid variants are as described for the hinge and CH1 domains above.

In certain embodiments, antibodies comprise at least an IgG2 hinge, and optionally also an IgG2 CH1 domain or fragment or derivative of the hinge and/or CH1 domain and the antibody has adopted form (of conformation) A (see, e.g., Allen et al. (2009) Biochemistry 48:3755). In certain embodiments, anti-CD73 antibodies comprise at least an IgG2 hinge, and optionally also an IgG2 CH1 domain or fragment or derivative of the hinge and/or CH1 domain and the antibody has adopted form B (see, e.g., Allen et al. (2009) Biochemistry 48:3755).

In certain embodiments, a modified heavy chain constant region comprises a CH2 domain that is a wildtype CH2 domain of the IgG1, IgG2, IgG3 or IgG4 isotype ("IgG1 CH2 domain," "IgG2 CH2 domain," "IgG3 CH2 domain,"

or "IgG4 CH2 domain," respectively). A CH2 domain may also be a variant of a wildtype CH2 domain, e.g., a variant of a wildtype IgG1, IgG2, IgG3 or IgG4 CH2 domain. Exemplary variants of CH2 domains include variants that modulate a biological activity of the Fc region of an antibody, such as ADCC or CDC or modulate the half-life of the antibody or its stability. In one embodiment, the CH2 domain is a human IgG1 CH2 domain with an A330S and P331S mutation, wherein the CH2 domain has reduced effector function relative to the same CH2 mutation without the mutations. A CH2 domain may have enhanced effector function. CH2 domains may comprise one or more of the following mutations: SE (S267E), SELF (S267E/L328F), SDIE (S239D/I332E), SEFF and GASDALIE (G236A/S239D/A330L/I332E) and/or one or more mutations at the following amino acids: E233, G237, P238, H268, P271, L328 and A330. Other mutations are further set forth herein elsewhere.

In certain embodiments, a modified heavy chain constant region comprises a CH3 domain that is a wildtype CH3 domain of the IgG1, IgG2, IgG3 or IgG4 isotype ("IgG1 CH3 domain," "IgG2 CH3 domain," "IgG3 CH3 domain," or "IgG4 CH3 domain," respectively. A CH3 domain may also be a variant of a wildtype CH3 domain, e.g., a variant of a wildtype IgG1, IgG2, IgG3 or IgG4 CH3 domain. Exemplary variants of CH3 domains include variants that modulate a biological activity of the Fc region of an antibody, such as ADCC or CDC or modulate the half-life of the antibody or its stability.

In certain embodiments, a modified heavy chain constant region comprises a hinge of the IgG2 isotype and a CH1 region of the IgG2 isotype. The IgG2 hinge and CH1 may be wild type IgG2 hinge and CH1 or variants thereof, provided that they have the desired biological activity. In certain embodiments, a modified heavy chain constant region comprises an IgG2 hinge comprising the C219S mutation, and an IgG2 CH1, which may be wild type or comprise at most 1-10, 1-5, 1-3, 1-2 or 1 amino acid substitution, deletion or addition. The modified heavy chain constant region may further comprise a wild type or mutated CH2 and CH3 domains. For example, a CD73 antibody may comprise a heavy chain constant domain comprising an IgG2 CH1 domain, an IgG2 hinge, which may comprise C219S, and an IgG1 CH2 and CH3 domain, wherein the CH2 and CH3 domain may be effectorless, such as comprising mutations A330S and P331S.

Generally, variants of the CH1, hinge, CH2 or CH3 domains may comprise 1, 2, 3, 4, 5, 6, 7, 8, 9, 10 or more mutations, and/or at most 10, 9, 8, 7, 6, 5, 4, 3, 2 or 1 mutation, or 1-10 or 1-5 mutations, or comprise an amino acid sequence that is at least about 75%, 80%, 85%, 90%, 95%, 96%, 97%, 98%, or 99% identical to that of the corresponding wildtype domain (CH1, hinge, CH2, or CH3 domain, respectively), provided that the heavy chain constant region comprising the specific variant retains the necessary biological activity.

Table 5 sets forth exemplary human heavy chain constant regions comprising a human CH1, hinge, CH2 and/or CH3 domains, wherein each domain is either a wildtype domain or a variant thereof that provides the desired biological activity to the heavy chain constant region. An unfilled cell in Table 5 indicates that the domain is present or not, and if present can be of any isotype, e.g., IgG1, IgG2, IgG3 or IgG4. For example, an antibody comprising the heavy chain constant region 1 in Table 5 is an antibody that comprises a heavy chain constant region comprising at least an IgG2 hinge, and which may also comprise a CH1, CH2 and/or CH3 domain, and if present, which CH1, CH2 and/or CH3 domain is of an IgG1, IgG2, IgG3 or IgG4 isotype. As another example for understanding Table 5, an antibody comprising a heavy chain constant region 8 is an antibody comprising a heavy chain constant region comprising an IgG1 CH1 domain, and IgG2 hinge, an IgG1 CH2 domain, and which may or may not also comprise a CH3 domain, which is present, may be of an IgG1, IgG2, IgG3 or IgG4 isotype.

TABLE 5

| MHCCR* | CH1 | Hinge | CH2 | CH3 |
|---|---|---|---|---|
| 1 | | IgG2 | | |
| 2 | IgG1 | IgG2 | | |
| 3 | IgG2 | IgG2 | | |
| 4 | | IgG2 | IgG1 | |
| 5 | | IgG2 | IgG2 | |
| 6 | | IgG2 | | IgG1 |
| 7 | | IgG2 | | IgG2 |
| 8 | IgG1 | IgG2 | IgG1 | |
| 9 | IgG1 | IgG2 | IgG2 | |
| 10 | IgG2 | IgG2 | IgG1 | |
| 11 | IgG2 | IgG2 | IgG2 | |
| 12 | IgG1 | IgG2 | | IgG1 |
| 13 | IgG1 | IgG2 | | IgG2 |
| 14 | IgG2 | IgG2 | | IgG1 |
| 15 | IgG2 | IgG2 | | IgG2 |
| 16 | | IgG2 | IgG1 | IgG1 |
| 17 | | IgG2 | IgG1 | IgG2 |
| 18 | | IgG2 | IgG2 | IgG1 |
| 19 | | IgG2 | IgG2 | IgG2 |
| 20 | IgG1 | IgG2 | IgG1 | IgG1 |
| 21 | IgG1 | IgG2 | IgG1 | IgG2 |
| 22 | IgG1 | IgG2 | IgG2 | IgG1 |
| 23 | IgG1 | IgG2 | IgG2 | IgG2 |
| 24 | IgG2 | IgG2 | IgG1 | IgG1 |
| 25 | IgG2 | IgG2 | IgG1 | IgG2 |
| 26 | IgG2 | IgG2 | IgG2 | IgG1 |
| 27 | IgG2 | IgG2 | IgG2 | IgG2 |

*Modified heavy chain constant region

In certain embodiments, an antibody comprising a heavy chain constant region shown in Table 5 has an enhanced biological activity relative to the same antibody comprising a heavy chain constant region that does not comprise that specific heavy chain constant region or relative to the same antibody that comprises an IgG1 constant region.

In certain embodiments, a method for improving the biological activity of a CD73 antibody that comprises a non-IgG2 hinge and/or non-IgG2 CH1 domain comprises providing an anti-CD73 antibody that comprises a non-IgG2 hinge and/or a non-IgG2 CH1 domain, and replacing the non-IgG2 hinge and the non-IgG2 CH1 domain with an IgG2 hinge and an IgG2 CH1 domain, respectively. A method for improving the biological activity of a CD73 antibody that does not comprise a modified heavy chain constant region, may comprise providing an anti-CD73 antibody that does not comprise a modified heavy chain constant region, and replacing its heavy chain constant region with a modified heavy chain constant region.

Exemplary modified heavy chain constant regions that may be linked to anti-CD73 variable regions, e.g., those described herein, are provided in Table 6, which sets forth the identity of each of the domains.

TABLE 6

| Modified heavy chain constant region | CH1 | Hinge | CH2 | CH3 | SEQ ID NO of whole MHCCR |
|---|---|---|---|---|---|
| IgG1-IgG2-IgG1f | IgG1 wildtype SEQ ID NO: 98 | IgG2/IgG1 SEQ ID NO: 178 | IgG1 wildtype SEQ ID NO: 137 | IgG1 wildtype SEQ ID NO: 138 | SEQ ID NO: 180 |
| IgG1-IgG2-IgG1f2 | IgG1 wildtype SEQ ID NO: 98 | IgG2 wildtype SEQ ID NO: 136 | IgG1 wildtype SEQ ID NO: 137 | IgG1 wildtype SEQ ID NO: 138 | SEQ ID NO: 162 |
| IgG1-IgG2CS-IgG1f | IgG1 wildtype SEQ ID NO: 98 | IgG2C219S/IgG1 SEQ ID NO: 179 | IgG1 wildtype SEQ ID NO: 137 | IgG1 wildtype SEQ ID NO: 138 | SEQ ID NO: 181 |
| IgG1-IgG2CS-IgG1f2 | IgG1 wildtype SEQ ID NO: 98 | IgG2 C219S SEQ ID NO: 123 | IgG1 wildtype SEQ ID NO: 137 | IgG1 wildtype SEQ ID NO: 138 | SEQ ID NO: 163 |
| IgG2-IgG1f | IgG2 wildtype SEQ ID NO: 124 | IgG2/IgG1 SEQ ID NO: 178 | IgG1 wildtype SEQ ID NO: 137 | IgG1 wildtype SEQ ID NO: 138 | SEQ ID NO: 182 |
| IgG2-IgG1f2 | IgG2 wildtype SEQ ID NO: 124 | IgG2 wildtype SEQ ID NO: 136 | IgG1 wildtype SEQ ID NO: 137 | IgG1 wildtype SEQ ID NO: 138 | SEQ ID NO: 164 |
| IgG2CS-IgG1f | IgG2 wildtype SEQ ID NO: 124 | IgG2C219S/IgG1 SEQ ID NO: 179 | IgG1 wildtype SEQ ID NO: 137 | IgG1 wildtype SEQ ID NO: 138 | SEQ ID NO: 183 |
| IgG2CS-IgG1f2 | IgG2 wildtype SEQ ID NO: 124 | IgG2 C219S SEQ ID NO: 123 | IgG1 wildtype SEQ ID NO: 137 | IgG1 wildtype SEQ ID NO: 138 | SEQ ID NO: 165 |
| IgG1-IgG2-IgG1.1f | IgG1 wildtype SEQ ID NO: 98 | IgG2 wildtype SEQ ID NO: 136 | IgG1 A330S/P331S SEQ ID NO: 125 | IgG1 wildtype SEQ ID NO: 138 | SEQ ID NO: 166 |
| IgG1-IgG2CS-IgG1.1f | IgG1 wildtype SEQ ID NO: 98 | IgG2 C219S SEQ ID NO: 123 | IgG1 A330S/P331S SEQ ID NO: 125 | IgG1 wildtype SEQ ID NO: 138 | SEQ ID NO: 167 |
| IgG2-IgG1.1f | IgG2 wildtype SEQ ID NO: 124 | IgG2 wildtype SEQ ID NO: 136 | IgG1 A330S/P331S SEQ ID NO: 125 | IgG1 wildtype SEQ ID NO: 138 | SEQ ID NO: 168 |
| IgG2CS-IgG1.1f | IgG2 wildtype SEQ ID NO: 124 | IgG2 C219S SEQ ID NO: 123 | IgG1 A330S/P331S SEQ ID NO: 125 | IgG1 wildtype SEQ ID NO: 138 | SEQ ID NO: 169 |

In certain embodiments, an antibody comprises a modified heavy chain constant region comprising an IgG2 hinge comprising SEQ ID NO: 123, 136, 178, 179, or 348-372 or a variant thereof, such as an IgG2 hinge comprising an amino acid sequence that (i) differs from SEQ ID NO: 123, 136, 178, 179, or 348-372 in 1, 2, 3, 4 or 5 amino acids substitutions, additions or deletions; (ii) differs from SEQ ID NO: 123, 136, 178, 179, or 348-372 in at most 5, 4, 3, 2, or 1 amino acids substitutions, additions or deletions; (iii) differs from SEQ ID NO: 123, 136, 178, 179, or 348-372 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to SEQ ID NO: 123, 136, 178, 179, or 348-372, wherein in any of (i)-(iv), an amino acid substitution may be a conservative amino acid substitution or a non-conservative amino acid substitution; and wherein the modified heavy chain constant region has an enhanced biological activity relative to that of another heavy chain constant region, e.g., a heavy chain constant region that comprises a non-IgG2 hinge or relative to the same modified heavy chain constant region that comprises a non-IgG2 hinge. For example, the hinge may be wildtype, or comprise a C219S, C220S or C219S and C220S substitutions.

In certain embodiments, an antibody comprises a modified heavy chain constant region comprising an IgG1 CH1 domain comprising SEQ ID NO: 98 or an IgG2 CH1 domain comprising SEQ ID NO: 124, or a variant of SEQ ID NO: 98 or 124, which variant (i) differs from SEQ ID NO: 98 or 124 in 1, 2, 3, 4 or 5 amino acids substitutions, additions or deletions; (ii) differs from SEQ ID NO: 98 or 124 in at most 5, 4, 3, 2, or 1 amino acids substitutions, additions or deletions; (iii) differs from SEQ ID NO: 98 or 124 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to SEQ ID NO: 98 or 124, wherein in any of (i)-(iv), an amino acid substitution may be a conservative amino acid substitution or a non-conservative amino acid substitution; and wherein the modified heavy chain constant region has an enhanced biological activity relative to that of another heavy chain constant region, e.g., a heavy chain constant region that comprises a non-IgG2 hinge or non-IgG2 hinge and CH1 domain or relative to the same modified heavy chain constant region that comprises a non-IgG2 hinge or non-IgG2 hinge and CH1 domain. An IgG2 CH1 domain may comprise C131S or other mutations that causes an IgG2 hinge and CH1 containing antibody to adopt either an A or a B form.

In certain embodiments, an antibody comprises a modified heavy chain constant region comprising an IgG1 CH2 domain comprising SEQ ID NO: 137 or 125, or a variant of SEQ ID NO: 137 or 125, which variant (i) differs from SEQ ID NO: 137 or 125 in 1, 2, 3, 4 or 5 amino acids substitutions, additions or deletions; (ii) differs from SEQ ID NO: 137 or 125 in at most 5, 4, 3, 2, or 1 amino acids substitutions, additions or deletions; (iii) differs from SEQ ID NO: 137 or 125 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to SEQ ID NO: 137 or 125, wherein in any of (i)-(iv), an amino acid substitution may be a conservative amino acid substitution or a non-conservative amino acid substitution; and wherein the modified heavy chain constant region has an enhanced biological activity relative to that of another heavy chain constant region, e.g., a heavy chain constant region that comprises a non-IgG2 hinge or relative to the same modified heavy chain constant region that comprises a non-IgG2 hinge.

In certain embodiments, an antibody comprises a modified heavy chain constant region comprising an IgG1 CH3 domain comprising SEQ ID NO: 138, or a variant of SEQ ID NO: 138, which variant (i) differs from SEQ ID NO: 138 in 1, 2, 3, 4 or 5 amino acids substitutions, additions or deletions; (ii) differs from SEQ ID NO: 138 in at most 5, 4, 3, 2, or 1 amino acids substitutions, additions or deletions; (iii) differs from SEQ ID NO: 138 in 1-5, 1-3, 1-2, 2-5 or 3-5 amino acids substitutions, additions or deletions and/or (iv) comprises an amino acid sequence that is at least about 75%, 80%, 85%, 90%, 95%, 96%, 97%, 98% or 99% identical to SEQ ID NO: 138, wherein in any of (i)-(iv), an amino acid substitution may be a conservative amino acid substitution or a non-conservative amino acid substitution; and wherein the modified heavy chain constant region has an enhanced biological activity relative to that of another heavy chain constant region, e.g., a heavy chain constant region that comprises a non-IgG2 hinge or relative to the same modified heavy chain constant region that comprises a non-IgG2 hinge.

Modified heavy chain constant regions may also comprise a combination of the CH1, hinge, CH2 and CH3 domains described above.

In certain embodiments, a CD73 antibody comprises a modified heavy chain constant region comprising any one of SEQ ID NOs: 162-169, 180-183, 267-282, and 300-347, or a variant of any one of SEQ ID NOs: 162-169, 180-183, 267-282, and 300-347, which variant (i) differs from SEQ ID NOs: 162-169, 180-183, 267-282, and 300-347 in 1, 2, 3, 4, 5, 6, 7, 8, 9, 10 or more amino acids substitutions, additions or deletions; (ii) differs from SEQ ID NOs: 162-169, 180-183, 267-282, and 300-347 in at most 10, 9, 8, 7, 6, 5, 4, 3, 2, or 1 amino acids substitutions, additions or deletions; (iii) differs from SEQ ID NOs: 162-169, 180-183, 267-282, and 300-347 in 1-5, 1-3, 1-2, 2-5, 3-5, 1-10, or 5-10 amino acids substitutions, additions or deletions and/or (iv) comprises an amino acid sequence that is at least about 75%, 80%, 85%, 90%, 95%, 96%, 97%, 98% or 99% identical to any one of SEQ ID NOs: 162-169, 180-183, 267-282, and 300-347, wherein in any of (i)-(iv), an amino acid substitution may be a conservative amino acid substitution or a non-conservative amino acid substitution; and wherein the modified heavy chain constant region has an enhanced biological activity relative to that of another heavy chain constant region, e.g., a heavy chain constant region that comprises a non-IgG2 hinge or non-IgG2 CH1 domain or relative to the same modified heavy chain constant region that comprises a non-IgG2 hinge and/or a non-IgG2 CH1 domain.

Modified heavy chain constant regions may have (i) similar, reduced or increased effector function (e.g., binding to an FcγR, e.g., FcγRIIB) relative to a wildtype heavy chain constant region and or (ii) similar, reduced or increased half-life (or binding to the FcRn receptor) relative to a wildtype heavy chain constant region.

The VH domain of an anti-CD73 antibody described herein may be linked to a heavy chain constant region described herein. For example, FIG. 18 shows the amino acid sequence of antibody CD73.4 linked to the heavy chain constant region IgG2CS-IgG1.1f (SEQ ID NO:133 or 169). Also encompassed herein are antibodies comprising a heavy chain comprising an amino acid sequence that differs from that of CD73.4-IgG2CS-IgG1.1f (SEQ ID NO:133 or 189) in at most 1-30, 1-25, 1-20, 1-15, 1-10, 1-5, 1-4, 1-3, 1-2 or 1 amino acid (by substitution, addition or deletion) and/or that are at least 80%, 85%, 90%, 95%, 96%, 97%, 98% or 99% identical to the amino acid sequence of the heavy chain of CD73.4-IgG2CS-IgG1.1f (SEQ ID NO:133 or 189). For example, encompassed herein are antibodies comprising the heavy chain of CD73.4-IgG2CS-IgG1.1f (SEQ ID NO: 133 or 189), and wherein the C-terminal K or GK or PGK are deleted or are present. Other variants of CD73.4-IgG2CS-IgG1.1f (SEQ ID NO:133 or 189) include those having a heavy chain that is of a different allotype, and wherein, e.g., amino acids 356 and 358 are D and L, respectively. Variants include those having an additional cysteine mutated in the IgG2 hinge, e.g., C220 (or have C220S instead of C219S), and those that do not have the mutations A330S and/or P331S. Variants of CD73.4-IgG2CS-IgG1.1f (SEQ ID NO:133 or 189) preferably have at least similar biochemical properties and/or biological activities, e.g., efficiency of internalization, inhibition of CD73 enzymatic activity, affinity for human CD73, and binding to the same or similar epitope, relative to CD73.4-IgG2CS-IgG1.1f (SEQ ID NO:133 or 189).

In certain embodiments, the anti-CD73 antibodies, or antigen binding portions thereof, comprise any one of the constant regions described herein, e.g., constant regions comprising the amino acid sequences set forth in SEQ ID NOs: 126, 127, 129, 130, 162-169, 180-183, 267-282, and 300-347.

A light chain of an anti-CD73 antibody may comprise a light chain constant region comprising SEQ ID NO: 131, or a variant of SEQ ID NO: 131, which variant (i) differs from SEQ ID NO: 131 in 1, 2, 3, 4, 5, 6, 7, 8, 9, 10 or more amino acids substitutions, additions or deletions; (ii) differs from SEQ ID NO: 131 in at most 10, 9, 8, 7, 6, 5, 4, 3, 2, or 1 amino acids substitutions, additions or deletions; (iii) differs from SEQ ID NO: 131 in 1-5, 1-3, 1-2, 2-5, 3-5, 1-10, or 5-10 amino acids substitutions, additions or deletions and/or (iv) comprises an amino acid sequence that is at least about 75%, 80%, 85%, 90%, 95%, 96%, 97%, 98% or 99% identical to SEQ ID NO: 131, wherein in any of (i)-(iv), an amino acid substitution may be a conservative amino acid substitution or a non-conservative amino acid substitution. An exemplary CL mutation includes C124S.

Heavy and light chains comprising an amino acid sequence that is at least 99%, 98%, 97%, 96%, 95%, 90%, 85%, 80%, 75% or 70% identical to any of the heavy or light chains set forth in Table 35, as detailed herein (or their variable regions), may be used for forming anti-human CD73 antibodies having the desired characteristics, e.g., those further described herein. Exemplary variants are those comprising an allotypic variation, e.g., in the constant domain. Heavy and light chains comprising an amino acid sequence that differs in at most 1-30, 1-25, 1-20, 1-15, 1-10, 1-5, 1-4, 1-3, 1-2 or 1 amino acid (by substitution, addition or deletion) from any of the heavy or light chains set forth in Table 35, as described herein (or their variable regions), may be used for forming anti-human CD73 antibodies having the desired characteristics, e.g., those further described herein.

In various embodiments, the antibodies described above exhibit one or more, two or more, three or more, four or more, five or more, six or more, seven or more, eight or more, nine or more, ten, or all of the functional properties listed in Table 3.

Such antibodies include, for example, human antibodies, humanized antibodies, or chimeric antibodies.

In one embodiment, the anti-CD73 antibodies described herein bind to both glycosylated (e.g., N-linked or O-linked glycosylation) and unglycosylated human CD73. Certain anti-CD73 antibodies may bind to glycosylated, but not unglycosylated CD73 or to unglycosylated but not glycosylated CD73.

In one embodiment, the anti-CD73 antibodies described herein bind to a conformational epitope.

In one embodiment, the anti-CD73 antibodies described herein bind to amino acid residues within the following region of human CD73:

FTKVQQIRRAEPNVLLLDA (SEQ ID NO: 96) and corresponding to amino acid residues 65-83 of human CD73 (SEQ ID NO: 1 or 2), as determined by, e.g., HDX-MS.

In one embodiment, the anti-CD73 antibodies described herein bind to all or a portion of the following amino acid residues in human CD73: FTKVQQIRRAEPNVLLLDA (SEQ ID NO: 96), which corresponds to amino acid residues 65-83 of human CD73 (SEQ ID NO: 1 or 2), as determined by, e.g., HDX-MS.

In one embodiment, the anti-CD73 antibody described herein binds to amino acid residues within the following region of human CD73:

LYLPYKVLPVGDEVVG (SEQ ID NO: 97), corresponding to amino acid residues 157-172 of human CD73 (SEQ ID NO: 1 or 2), as determined by, e.g., HDX-MS.

In one embodiment, the anti-CD73 antibody described herein binds to all or a portion of the following amino acid residues within human CD73: LYLPYKVLPVGDEVVG (SEQ ID NO: 97), which corresponds to amino acid residues 157-172 of human CD73 (SEQ ID NO: 1 or 2), as determined by, e.g., HDX-MS.

In one embodiment, the anti-CD73 antibody described herein binds to discontinuous amino acid residues within the following regions of human CD73 (SEQ ID NO: 1 or 2):

FTKVQQIRRAEPNVLLLDA (SEQ ID NO: 96) and LYLPYKVLPVGDEVVG (SEQ ID NO: 97).

In one embodiment, the anti-CD73 antibody described herein binds to all or a portion of the discontinuous amino acid residues within the following regions of human CD73 (SEQ ID NO: 1 or 2): FTKVQQIRRAEPNVLLLDA (SEQ ID NO: 96) and LYLPYKVLPVGDEVVG (SEQ ID NO: 97), which correspond to amino acid residues 65-83 and 157-172 of human CD73 (SEQ ID NO: 1 or 2), as determined by, e.g., HDX-MS.

In certain embodiments, anti-CD73 antibodies have interactions with human CD73 that correspond to those shown in Table 30, as determined by X-ray crystallography. An antibody may share at least 50%, 60%, 70%, 80%, 90%, 95% or 99% of the interactions with human CD73 that are shown in Table 30.

III. Antibodies Having Particular Germline Sequences

In certain embodiments, an anti-CD73 antibody comprises a heavy chain variable region from a particular germline heavy chain immunoglobulin gene and/or a light chain variable region from a particular germline light chain immunoglobulin gene.

As demonstrated herein, human antibodies specific for CD73 have been prepared that comprise a heavy chain variable region that is the product of or derived from a human germline VH 3-33 gene, VH 3-10 gene, VH 3-15 gene, VH 3-16, JH6b gene, VH 6-19 gene, VH 4-34 gene, and/or JH3b gene. Accordingly, provided herein are isolated monoclonal antibodies specific for human CD73, or antigen-binding portions thereof, comprising a heavy chain variable region that is the product of or derived from a human VH germline gene selected from the group consisting of: VH 3-33, VH 3-10, VH 3-15, VH 3-16, VH 6-19, and VH 4-34.

Human antibodies specific for CD73 have been prepared that comprise a light chain variable region that is the product of or derived from a human germline VK L6 gene, VK L18 gene, VK L15 gene, VK L20 gene, VK A27 gene, JK5 gene, JK4 gene, JK2 gene, and JK1 gene. Accordingly, provided herein are isolated monoclonal antibodies specific for human CD73, or antigen-binding portions thereof, comprising a light chain variable region that is the product of or derived from a human VK germline gene selected from the group consisting of: VK L6, VK L18, VK L15, VK L20, and VK A27.

Preferred antibodies described herein are those comprising a heavy chain variable region that is the product of or derived from one of the above-listed human germline VH genes and also comprising a light chain variable region that is the product of or derived from one of the above-listed human germline VK genes.

As used herein, a human antibody comprises heavy or light chain variable regions that are "the product of" or "derived from" a particular germline sequence if the variable regions of the antibody are obtained from a system that uses human germline immunoglobulin genes. Such systems include immunizing a transgenic mouse carrying human immunoglobulin genes with the antigen of interest or screening a human immunoglobulin gene library displayed on phage with the antigen of interest. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a selected human antibody typically is at least 90% identical in amino acids sequence to an amino acid sequence encoded by a human germline immunoglobulin gene and contains amino acid residues that identify the human antibody as being human when compared to the germline immunoglobulin amino acid sequences of other species (e.g., murine germline sequences). In certain cases, a human antibody may be at least 95%, or even at least 96%, 97%, 98%, or 99% identical in amino acid sequence to the amino acid sequence encoded by the germline immunoglobulin gene. Typically, a human antibody derived from a particular human germline sequence will display no more than 10 amino acid differences from the amino acid sequence encoded by the human germline immunoglobulin gene. In certain cases, the human antibody may display no more than 5, or even no more than 4, 3, 2, or 1 amino acid difference from the amino acid sequence encoded by the germline immunoglobulin gene.

IV. Homologous Antibodies

Encompassed herein are antibodies having heavy and light chain variable regions comprising amino acid sequences that are homologous to the amino acid sequences of the preferred antibodies described herein, and wherein the antibodies retain the desired functional properties of the anti-CD73 antibodies described herein.

For example, an isolated anti-CD73 antibody, or antigen binding portion thereof, may comprise a heavy chain variable region and a light chain variable region, wherein:

(a) the heavy chain variable region comprises an amino acid sequence that is at least 80%, 85%, 90%, 95%, 96%, 97%, 98% or 99% identical to an amino acid sequence selected from the group consisting of SEQ ID NOs: 4, 16, 32, 40, 52, 60, 68, 80, 88, 135, and 170-177, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 4, 16, 32, 40, 52, 60, 68, 80, 88, 135, and 170-177, respectively;

(b) the light chain variable region comprises an amino acid sequence that is at least 80%, 85%, 90%, 95%, 96%, 97%, 98% or 99% identical to an amino acid sequence selected from the group consisting of SEQ ID NOs: 8, 12, 20, 24, 28, 36, 44, 48, 56, 64, 72, 76, 84, 92, and 138, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 8, 12, 20, 24, 28, 36, 44, 48, 56, 64, 72, 76, 84, 92, and 238, respectively;

(c) the antibody specifically binds to CD73, and (d) the antibody exhibits 1, 2, 3, 4, 5, 6, 7, 8, 9, 10, or all of the functional properties listed in Table 3.

In certain embodiments, the anti-CD73 antibodies comprise heavy and light chain variable regions with the percent identities and/or amino acid changes and functions discussed above (i.e., (a)-(d)), wherein the CDR3 of the heavy chain variable region comprises an amino acid sequence selected from the group consisting of SEQ ID NOs: 7, 19, 35, 43, 55, 63, 71, 83, and 91, and optionally the CDR1 of the heavy chain variable region comprises an amino acid sequence selected from the group consisting of SEQ ID NOs: 5, 17, 33, 41, 53, 61, 69, 81, and 89, and optionally the CDR2 of the heavy chain variable region comprises an amino acid sequence selected from the group consisting of SEQ ID NOs: 6, 18, 34, 42, 54, 62, 70, 82, and 90.

In certain embodiments, the anti-CD73 antibodies comprise heavy and light chain variable regions with the percent identities and/or amino acid changes and functions discussed above (i.e., (a)-(d)), wherein the CDR3 of the light chain variable region comprises an amino acid sequence selected from the group consisting of SEQ ID NOs: 11, 15, 23, 27, 31, 39, 47, 51, 59, 67, 75, 79, 87, 95, and 241, and optionally the CDR1 of the light chain variable region comprises an amino acid sequence selected from the group consisting of SEQ ID NOs: 9, 13, 21, 25, 29, 37, 45, 49, 57, 65, 73, 77, 85, 93, and 239, and optionally the CDR2 of the light chain variable region comprises an amino acid sequence selected from the group consisting of SEQ ID NOs: 10, 14, 22, 26, 30, 38, 46, 50, 58, 66, 74, 78, 86, 94, and 240.

In certain embodiments, the anti-CD73 antibodies comprise heavy and light chain variable regions with the percent identities and/or amino acid changes and functions discussed above (i.e., (a)-(d)), wherein the CDR3 of the heavy chain variable region comprises an amino acid sequence selected from the group consisting of SEQ ID NOs: 7, 19, 35, 43, 55, 63, 71, 83, and 91, and optionally the CDR1 of the heavy chain variable region comprises an amino acid sequence selected from the group consisting of SEQ ID NOs: 5, 17, 33, 41, 53, 61, 69, 81, and 89, and optionally the CDR2 of the heavy chain variable region comprises an amino acid sequence selected from the group consisting of SEQ ID NOs: 6, 18, 34, 42, 54, 62, 70, 82, and 90, and wherein the CDR3 of the light chain variable region comprises an amino acid sequence selected from the group consisting of SEQ ID NOs: 11, 15, 23, 27, 31, 39, 47, 51, 59, 67, 75, 79, 87, 95, and 241, and optionally the CDR1 of the light chain variable region comprises an amino acid sequence selected from the group consisting of SEQ ID NOs: 9, 13, 21, 25, 29, 37, 45, 49, 57, 65, 73, 77, 85, 93, and 239, and optionally the CDR2 of the light chain variable region comprises an amino acid sequence selected from the group consisting of SEQ ID NOs: 10, 14, 22, 26, 30, 38, 46, 50, 58, 66, 74, 78, 86, 94, and 240.

In various embodiments, the antibody can be, for example, a human antibody, a humanized antibody or a chimeric antibody.

An isolated anti-CD73 antibody, or antigen binding portion thereof, may comprise a heavy chain and a light chain, wherein:

(a) the heavy chain comprises an amino acid sequence that is at least 80%, 85%, 90%, 95%, 96%, 97%, 98% or 99% identical to an amino acid sequence selected from the group consisting of SEQ ID NOs: 100, 103, 107, 109, 112, 114, 116, 119, 121, 133, 184-210 or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 100, 103, 107, 109, 112, 114, 116, 119, 121, 133, and 184-210, respectively;

(b) the light chain comprises an amino acid sequence that is at least 80%, 85%, 90%, 95%, 96%, 97%, 98% or 99% identical to an amino acid sequence selected from the group consisting of SEQ ID NOs: 101, 102, 104, 105, 106, 108, 110, 111, 113, 115, 117, 118, 120 and 122 or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 101, 102, 104, 105, 106, 108, 110, 111, 113, 115, 117, 118, 120 and 122, respectively;

(c) the antibody specifically binds to CD73, and (d) the antibody exhibits 1, 2, 3, 4, 5, 6, 7, 8, 9, 10, or all of the functional properties listed in Table 3.

In certain embodiments, the anti-CD73 antibodies comprise heavy and light chains with the percent identities and/or amino acid changes and functions discussed above (i.e., (a)-(d)), wherein the CDR3 of the heavy chain variable region comprises an amino acid sequence selected from the group consisting of SEQ ID NOs: 7, 19, 35, 43, 55, 63, 71, 83, and 91, and optionally the CDR1 of the heavy chain variable region comprises an amino acid sequence selected from the group consisting of SEQ ID NOs: 5, 17, 33, 41, 53, 61, 69, 81, and 89, and optionally the CDR2 of the heavy chain variable region comprises an amino acid sequence selected from the group consisting of SEQ ID NOs: 6, 18, 34, 42, 54, 62, 70, 82, and 90.

In certain embodiments, the anti-CD73 antibodies comprise heavy and light chains with the percent identities and/or amino acid changes and functions discussed above (i.e., (a)-(d)), wherein the CDR3 of the light chain variable region comprises an amino acid sequence selected from the group consisting of SEQ ID NOs: 11, 15, 23, 27, 31, 39, 47, 51, 59, 67, 75, 79, 87, 95, and 241, and optionally the CDR1 of the light chain variable region comprises an amino acid sequence selected from the group consisting of SEQ ID NOs: 9, 13, 21, 25, 29, 37, 45, 49, 57, 65, 73, 77, 85, 93, and 239, and optionally the CDR2 of the light chain variable region comprises an amino acid sequence selected from the group consisting of SEQ ID NOs: 10, 14, 22, 26, 30, 38, 46, 50, 58, 66, 74, 78, 86, 94, and 240.

In certain embodiments, the anti-CD73 antibodies comprise heavy and light chains with the percent identities and/or amino acid changes and functions discussed above (i.e., (a)-(d)), wherein the CDR3 of the heavy chain variable region comprises an amino acid sequence selected from the group consisting of SEQ ID NOs: 7, 19, 35, 43, 55, 63, 71, 83, and 91, and optionally the CDR1 of the heavy chain variable region comprises an amino acid sequence selected from the group consisting of SEQ ID NOs: 5, 17, 33, 41, 53, 61, 69, 81, and 89, and optionally the CDR2 of the heavy chain variable region comprises an amino acid sequence selected from the group consisting of SEQ ID NOs: 6, 18, 34, 42, 54, 62, 70, 82, and 90, and wherein the CDR3 of the light chain variable region comprises an amino acid sequence selected from the group consisting of SEQ ID NOs: 11, 15, 23, 27, 31, 39, 47, 51, 59, 67, 75, 79, 87, 95, and 241, and optionally the CDR1 of the light chain variable region comprises an amino acid sequence selected from the group consisting of SEQ ID NOs: 9, 13, 21, 25, 29, 37, 45, 49, 57, 65, 73, 77, 85, 93, and 239, and optionally the CDR2 of the light chain variable region comprises an amino acid sequence selected from the group consisting of SEQ ID NOs: 10, 14, 22, 26, 30, 38, 46, 50, 58, 66, 74, 78, 86, 94, and 240.

Also provided are anti-CD73 antibodies comprising a VHCDR1, VHCDR2, VHCDR3, VLCDR1, VLCDR2, and/or VLCDR3 that differs from the corresponding CDRs of CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11, in 1, 2, 3, 4, 5, 1-2, 1-3, 1-4, or 1-5 amino acid changes (i.e., amino acid substitutions, additions or deletions). In certain embodiments, an anti-CD73 antibody comprises 1-5 amino acid changes in each of 1, 2, 3, 4, 5 or 6 of the CDRs relative to the corresponding sequences in CD73.4-1, CD73.4-2, CD73.3, 11F11-1, 11F11-2, 11F11, 4C3-1, 4C3-2, 4C3-3, 4D4, 10D2-1, 10D2-2, 11A6, 24H2, 5F8-1, 5F8-2, 6E11 and/or 7A11. In certain embodiments, an anti-CD73 antibody comprises at total of 1-5 amino acid changes across all CDRs relative to the CDRs in CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11.

In certain embodiments, an anti-CD73 antibody comprises VH and VL CDRs consisting of those of CD73.4-1 or CD73.4-2, wherein one or more of the amino acids in one or more CDRs are those of one of the other anti-CD73 antibodies disclosed herein.

Mutations (e.g., substitutions, additions, deletions) that can be made in the variable region sequences of the anti-CD73 antibodies can be determined based on the following: (i) the mutations that were introduced into the antibodies, as described in the Examples; and (ii) the comparison of the amino acid residues at each position in the variable domains of the anti-CD73 antibodies described herein (see Table 35 and FIG. 35): a different amino acid at a certain position in anti-CD73 antibodies may indicate that the amino acid residue at this position may be changed to another amino acid residue without significantly affecting the activities of the antibody; whereas if the same amino acid residue is found in the same position in several or all anti-CD73 antibodies, this may indicate that this particular amino acid should be preserved and not changed to another residue. Exemplary embodiments are provided below.

In certain embodiments, a framework substitution can be introduced at position 25 ( . . . RLSCA$\underline{T}$SGFTF . . . in 11F11) of the heavy chain variable region (e.g., a conservative substitution, e.g., to S or A) of the anti-CD73 antibodies described herein. For example, if the amino acid at this position is T, a substitution to A or S can be introduced; if the amino acid at this position is A, a substitution to S or T can be introduced; and if the amino acid at this position is S, a substitution to T or A can be introduced. Antibodies 24H2, 4D4, 10D2, 6E11, 7A11, 11A6, and 4C3 have an A at this position, 11F11 has a T at this position, and 73.5, 73.7, and 73.9 have an S at this position.

Similarly, in certain embodiments, a framework substitution can be introduced at amino acid position 94 ( . . . AEDTA$\underline{V}$YYCAR . . . in 11F11) of the heavy chain variable region (e.g., V to L or L to V). For example, antibodies 11F11, 73.3-73.10, 24H2, 4D4, 5F8, and 10D2 have a V at this position, and 6E11, 7A11, 11A6, and 4C3 have an L at this position.

In certain embodiments, amino acid substitutions can be made to the heavy chain variable region CDR2 of the anti-CD73 antibodies disclosed herein. For example, the amino acid at position 52 ( . . . WVAVI$\underline{L}$YDGSN . . . in 11F11) can be substituted with W, or if the amino acid at this position is W, then the amino acid can be substituted with L (antibodies 11F11 and 73.4-73.7 have an L at this position, and antibodies 73.8-73.10, 24H2, and 4D4 have a W at this position).

Similarly, in certain embodiments, the amino acid at position 54 ( . . . VILYD$\underline{G}$SNKYY . . . in 11F11) can be substituted with S or E, or if the amino acid at this position is S, then the amino acid can be substituted with E. Antibodies 11F11, 73.4, 73.5, 24H2, 10D2, and 5F8 have a G at this position, antibodies 73.6-73.9, 6E11, 7A11, 4C3, and 73.3 have a S at this position, and antibodies 73.10 and 4D4 have an E at this position.

Other permissible substitutions in the variable region can be determined based on the alignment of the heavy and light chain variable region sequences in FIG. 35 using a similar rationale as described above.

Antibodies having sequences with homology to those of CD73.3, CD73.4, CD73.5, CD73.6, CD73.7, CD73.8, CD73.9, CD73.10, CD73.11, 11F11, 4C3, 4D4, 10D2, 11A6, 24H2, 5F8, 6E11 and/or 7A11, e.g., the $V_H$ and $V_L$ regions of SEQ ID NOs: 4, 16, 32, 40, 52, 60, 68, 80, 88, 135, 170-177, and SEQ ID NOs: 8, 12, 20, 24, 28, 36, 44, 48, 56, 64, 72, 76, 84, 92, respectively, or heavy and light chains of SEQ ID NOs: 100, 103, 107, 109, 112, 114, 116, 119, 121, 133, and 184-210, and SEQ ID NOs: 101, 102, 104, 105, 106, 108, 110, 111, 113, 115, 117, 118, 120 and 122, respectively, or CDRs can be obtained by mutagenesis (e.g., site-directed or PCR-mediated mutagenesis) of nucleic acid molecules, e.g., SEQ ID NOs: 139, 142, 146, 148, 151, 153, 155, 158, 160, 237 and/or SEQ ID NOs: 140, 141, 143, 144, 145, 147, 149, 150, 152, 154, 156, 157, 159, 161 or SEQ ID NOs: 134, 243, 246, 250, 252, 255, 257, 259, 262, 264, and/or SEQ ID NOs: 244, 245, 247, 248, 249, 251, 253, 254, 256, 258, 260, 261, 263, 265, 266 followed by testing of the encoded altered antibody for retained function using the functional assays described herein.

V. Antibodies with Conservative Modifications

Anti-CD73 antibodies may comprise a heavy chain variable region comprising CDR1, CDR2 and CDR3 sequences and a light chain variable region comprising CDR1, CDR2 and CDR3 sequences, wherein one or more of these CDR sequences comprise specified amino acid sequences based on the preferred antibodies described herein e.g., of CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11, or conservative modifications thereof, and wherein the antibodies retain the desired functional properties of the anti-CD73 antibodies described herein. Accordingly, an isolated anti-CD73 antibody, or antigen binding portion thereof, may comprise a heavy chain variable region comprising CDR1, CDR2, and CDR3 sequences and a light chain variable region comprising CDR1, CDR2, and CDR3 sequences, wherein:

(a) the heavy chain variable region CDR3 sequence comprises an amino acid sequence selected from the group consisting of amino acid sequences of SEQ ID NOs: 7, 19, 35, 43, 55, 63, 71, 83, and 91, and conservative modifications thereof, e.g., 1, 2, 3, 4, 5, 1-2, 1-3, 1-4 or 1-5 conservative amino acid substitutions;
(b) the light chain variable region CDR3 sequence comprises an amino acid sequence selected from the group consisting of amino acid sequence of SEQ ID NOs: 11, 15, 23, 27, 31, 39, 47, 51, 59, 67, 75, 79, 87, and 95, and conservative modifications thereof, e.g., 1, 2, 3, 4, 5, 1-2, 1-3, 1-4 or 1-5 conservative amino acid substitutions;
(c) the antibody specifically binds to CD73, and
(d) the antibody exhibits 1, 2, 3, 4, 5, 6, 7, 8, 9, 10, or all of the functional properties listed in Table 3.

In a preferred embodiment, the heavy chain variable region CDR2 sequence comprises an amino acid sequence selected from the group consisting of amino acid sequences of SEQ ID NOs: 6, 18, 34, 42, 54, 62, 70, 82, and 90, and conservative modifications thereof, e.g., 1, 2, 3, 4, 5, 1-2, 1-3, 1-4 or 1-5 conservative amino acid substitutions; and the light chain variable region CDR2 sequence comprises an amino acid sequence selected from the group consisting of amino acid sequences of SEQ ID NOs: 10, 14, 22, 26, 30, 38, 46, 50, 58, 66, 74, 78, 86, and 94, and conservative modifications thereof, e.g., 1, 2, 3, 4, 5, 1-2, 1-3, 1-4 or 1-5 conservative amino acid substitutions. In another preferred embodiment, the heavy chain variable region CDR1 sequence comprises an amino acid sequence selected from the group consisting of amino acid sequences of SEQ ID NOs: 5, 17, 33, 41, 53, 61, 69, 81, and 89, and conservative modifications thereof, e.g., 1, 2, 3, 4, 5, 1-2, 1-3, 1-4 or 1-5 conservative amino acid substitutions; and the light chain variable region CDR1 sequence comprises an amino acid sequence selected from the group consisting of amino acid sequences of SEQ ID NOs: 9, 13, 21, 25, 29, 37, 45, 49, 57, 65, 73, 77, 85, and 93, and conservative modifications thereof, e.g., 1, 2, 3, 4, 5, 1-2, 1-3, 1-4 or 1-5 conservative amino acid substitutions.

In various embodiments, the antibodies can be, for example, human antibodies, humanized antibodies or chimeric antibodies.

Conservative amino acid substitutions may also be made in portions of the antibodies other than, or in addition to, the CDRs. For example, conservative amino acid modifications may be made in a framework region or in the constant region, e.g., Fc region. Any of the substitutions described herein may be a conservative substitution. A variable region or a heavy or light chain may comprise 1, 2, 3, 4, 5, 1-2, 1-3, 1-4, 1-5, 1-10, 1-15, 1-20, 1-25, or 1-50 conservative amino acid substitutions relative to the anti-CD73 antibody sequences provided herein. In certain embodiments, an anti-CD73 antibody comprises a combination of conservative and non-conservative amino acid modification.

VI. Antibodies that Bind the Same Epitope on CD73 as or Compete for Binding to CD73 with the Antibodies Described Herein Also provided are antibodies that compete for binding to CD73 with the particular anti-CD73 antibodies described herein (e.g., antibodies CD73.4, CD73.3, 11F11, 4C3, 4D4, 10D2, 11A6, 24H2, 5F8, 6E11 and 7A11). Such competing antibodies can be identified based on their ability to competitively inhibit binding to CD73 of one or more monoclonal antibodies 11F11-1, 11F11-2, 4C3-1, 4C3-2, 4C3-3, 4D4, 10D2-1, 10D2-2, 11A6, 24H2, 5F8-1, 5F8-2, 6E11 7A11 and/or CD73.3 or CD73.4 (with any constant regions and light chains described herein for these antibodies) in standard CD73 binding assays. For example, standard ELISA assays or competitive ELISA assays can be used in which a recombinant human CD73 protein is immobilized on the plate, various concentrations of unlabeled first antibody are added, the plate is washed, labeled second antibody is added, washed, and the amount of bound label is measured. If the increasing concentration of the unlabeled (first) antibody (also referred to as the "blocking antibody") inhibits the binding of the labeled (second) antibody, the first antibody is said to inhibit the binding of the second antibody to the target on the plate, or is said to compete with the binding of the second antibody. Additionally or alternatively, BIACORE® SPR analysis can be used to assess the ability of the antibodies to compete. The ability of a test antibody to inhibit the binding of an anti-CD73 antibody described herein to CD73 demonstrates that the test antibody can compete with the antibody for binding to CD73.

Also provided herein are anti-CD73 antibodies that inhibit the binding of anti-CD73 antibodies described herein to CD73 on cells, e.g., tumor cells, by at least 10%, 20%, 30%, 40%, 50%, 55%, 60%, 65%, 70%, 75%, 80%, 85%, 90%, 91%, 92%, 93%, 94%, 95%, 96%, 97%, 98%, 99%, or 100% and/or whose binding to CD73 on cells, e.g., tumor cells, is inhibited by at least 10%, 20%, 30%, 40%, 50%, 55%, 60%, 65%, 70%, 75%, 80%, 85%, 90%, 91%, 92%, 93%, 94%, 95%, 96%, 97%, 98%, 99%, or 100%, e.g., as measured by ELISA or FACS, such as by using the assay described in the preceding paragraph.

Antibodies that compete for binding with the anti-CD73 antibodies described herein may be identified by using art-known methods. For example, mice may be immunized with human CD73 as described herein, hybridomas produced, and the resulting monoclonal antibodies screened for the ability to compete with an antibody described herein for binding to CD73. Mice can also be immunized with a smaller fragment of CD73 containing the epitope to which the antibody binds. The epitope or region comprising the epitope can be identified by, e.g., screening for binding to a series of overlapping peptides spanning CD73. Alternatively, the method of Jespers et al., Biotechnology 12:899, 1994 may be used to guide the selection of antibodies having the same epitope and therefore similar properties to the an anti-CD73 antibody described herein. Using phage display, first the heavy chain of the anti-CD73 antibody is paired with a repertoire of (preferably human) light chains to select a CD73-binding antibody, and then the new light chain is paired with a repertoire of (preferably human) heavy chains to select a (preferably human) CD73-binding antibody having the same epitope or epitope region as an anti-CD73 antibody described herein. Alternatively variants of an antibody described herein can be obtained by mutagenesis of cDNA encoding the heavy and light chains of the antibody.

Techniques for determining antibodies that bind to the "same epitope on CD73" with the antibodies described herein include, for example, epitope mapping methods, such as x-ray analyses of crystals of antigen: antibody complexes, which provides atomic resolution of the epitope. Other methods monitor the binding of the antibody to antigen fragments or mutated variations of the antigen where loss of binding due to a modification of an amino acid residue within the antigen sequence is often considered an indication of an epitope component. In addition, computational combinatorial methods for epitope mapping can also be used. Methods may also rely on the ability of an antibody of interest to affinity isolate specific short peptides (either in native three dimensional form or in denatured form) from combinatorial phage display peptide libraries. The peptides are then regarded as leads for the definition of the epitope corresponding to the antibody used to screen the peptide library. For epitope mapping, computational algorithms have also been developed which have been shown to map conformational discontinuous epitopes.

Alanine scanning mutagenesis, as described by Cunningham and Wells (1989) Science 244: 1081-1085, or some other form of point mutagenesis of amino acid residues in CD73 may also be used to determine the functional epitope for an anti-CD73 antibody. Mutagenesis studies, however, may also reveal amino acid residues that are crucial to the overall three-dimensional structure of CD73 but that are not directly involved in antibody-antigen contacts, and thus other methods may be necessary to confirm a functional epitope determined using this method.

The epitope or epitope region (an "epitope region" is a region comprising the epitope or overlapping with the epitope) bound by a specific antibody may also be determined by assessing binding of the antibody to peptides comprising fragments of CD73, e.g., non-denatured or denatured fragments. A series of overlapping peptides encompassing the sequence of CD73 (e.g., human CD73) may be synthesized and screened for binding, e.g. in a direct ELISA, a competitive ELISA (where the peptide is assessed for its ability to prevent binding of an antibody to CD73 bound to a well of a microtiter plate), or on a chip. Such peptide screening methods may not be capable of detecting some discontinuous functional epitopes, i.e. functional epitopes that involve amino acid residues that are not contiguous along the primary sequence of the CD73 polypeptide chain.

An epitope may also be identified by MS-based protein footprinting, such as Hydrogen/deuterium exchange mass spectrometry (HDX-MS) and Fast Photochemical Oxidation of Proteins (FPOP). HDX-MS may be conducted, e.g., as further described in the Examples and in Wei et al. (2014) Drug Discovery Today 19:95, the methods of which are specifically incorporated by reference herein. FPOP may be conducted as described, e.g., in Hambley and Gross (2005) J. American Soc. Mass Spectrometry 16:2057, the methods of which are specifically incorporated by reference herein.

The epitope bound by anti-CD73 antibodies may also be determined by structural methods, such as X-ray crystal structure determination (e.g., WO2005/044853), molecular modeling and nuclear magnetic resonance (NMR) spectroscopy, including NMR determination of the H-D exchange rates of labile amide hydrogens in CD73 when free and when bound in a complex with an antibody of interest (Zinn-Justin et al. (1992) Biochemistry 31, 11335-11347; Zinn-Justin et al. (1993) Biochemistry 32, 6884-6891).

With regard to X-ray crystallography, crystallization may be accomplished using any of the known methods in the art (e.g. Giege et al. (1994) Acta Crystallogr. D50:339-350; McPherson (1990) Eur. J. Biochem. 189:1-23), including microbatch (e.g. Chayen (1997) Structure 5:1269-1274), hanging-drop vapor diffusion (e.g. McPherson (1976) J. Biol. Chem. 251:6300-6303), seeding and dialysis. It is desirable to use a protein preparation having a concentration of at least about 1 mg/mL and preferably about 10 mg/mL to about 20 mg/mL. Crystallization may be best achieved in a precipitant solution containing polyethylene glycol 1000-20,000 (PEG; average molecular weight ranging from about 1000 to about 20,000 Da), preferably about 5000 to about 7000 Da, more preferably about 6000 Da, with concentrations ranging from about 10% to about 30% (w/v). It may also be desirable to include a protein stabilizing agent, e.g.

glycerol at a concentration ranging from about 0.5% to about 20%. A suitable salt, such as sodium chloride, lithium chloride or sodium citrate may also be desirable in the precipitant solution, preferably in a concentration ranging from about 1 mM to about 1000 mM. The precipitant is preferably buffered to a pH of from about 3.0 to about 5.0, preferably about 4.0. Specific buffers useful in the precipitant solution may vary and are well-known in the art (Scopes, Protein Purification: Principles and Practice, Third ed., (1994) Springer-Verlag, New York). Examples of useful buffers include, but are not limited to, HEPES, Tris, MES and acetate. Crystals may be grow at a wide range of temperatures, including 2° C., 4° C., 8° C. and 26° C.

Antibody:antigen crystals may be studied using well-known X-ray diffraction techniques and may be refined using computer software such as X-PLOR (Yale University, 1992, distributed by Molecular Simulations, Inc.; see e.g. Blundell & Johnson (1985) Meth. Enzymol. 114 & 115, H. W. Wyckoff et al., eds., Academic Press; U.S. Patent Application Publication No. 2004/0014194), and BUSTER (Bricogne (1993) Acta Cryst. D49:37-60; Bricogne (1997) Meth. Enzymol. 276A:361-423, Carter & Sweet, eds.; Roversi et al. (2000) Acta Cryst. D56:1313-1323), the disclosures of which are hereby incorporated by reference in their entireties.

Anti-CD73 antibodies may bind to the same epitope as any of the anti-CD73 antibodies having amino acid sequences described herein, as determined by an epitope mapping technique, such as a technique described herein. Anti-CD73 antibodies may also have similar interactions with human CD73, e.g., they may have at least about 50%, 60%, 70%, 80%, 90%, 95% or more of the interactions shown in Table 30, as determined by X-ray crystallography.

VII. Engineered and Modified Antibodies

VH and VL Regions

Also provided are engineered and modified antibodies that can be prepared using an antibody having one or more of the $V_H$ and/or $V_L$ sequences disclosed herein as starting material to engineer a modified antibody, which modified antibody may have altered properties from the starting antibody. An antibody can be engineered by modifying one or more residues within one or both variable regions (i.e., $V_H$ and/or $V_L$), for example within one or more CDR regions and/or within one or more framework regions. Additionally or alternatively, an antibody can be engineered by modifying residues within the constant region(s), for example to alter the effector function(s) of the antibody.

One type of variable region engineering that can be performed is CDR grafting. Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to express recombinant antibodies that mimic the properties of specific reference antibodies by constructing expression vectors that include CDR sequences from the specific reference antibody grafted onto framework sequences from a different antibody with different properties (see, e.g., Riechmann, L. et al. (1998) *Nature* 332:323-327; Jones, P. et al. (1986) *Nature* 321:522-525; Queen, C. et al. (1989) *Proc. Natl. Acad. See. U.S.A.* 86:10029-10033; U.S. Pat. No. 5,225,539 to Winter, and U.S. Pat. Nos. 5,530,101; 5,585,089; 5,693,762 and 6,180,370 to Queen et al.)

Accordingly, another embodiment described herein pertains to an isolated monoclonal antibody, or antigen binding portion thereof, comprising a heavy chain variable region comprising CDR1, CDR2, and CDR3 sequences comprising an amino acid sequence selected from the group consisting of SEQ ID NOs: 5, 17, 33, 41, 53, 61, 69, 81, and 89, SEQ ID NOs: 6, 18, 34, 42, 54, 62, 70, 82, and 90, and SEQ ID NOs: 7, 19, 35, 43, 55, 63, 71, 83, and 91, respectively, and a light chain variable region comprising CDR1, CDR2, and CDR3 sequences comprising an amino acid sequence selected from the group consisting of SEQ ID NOs: 9, 13, 21, 25, 29, 37, 45, 49, 57, 65, 73, 77, 85, and 93, SEQ ID NOs: 10, 14, 22, 26, 30, 38, 46, 50, 58, 66, 74, 78, 86, and 94, and SEQ ID NOs:11, 15, 23, 27, 31, 39, 47, 51, 59, 67, 75, 79, 87, and 95, respectively. Thus, such antibodies contain the $V_H$ and $V_L$ CDR sequences of monoclonal antibodies CD73.4-1, CD73.4-2, 11F11-1, 11F11-2, 4C3-1, 4C3-2, 4C3-3, 4D4, 10D2-1, 10D2-2, 11A6, 24H2, 5F8-1, 5F8-2, 6E11 and 7A11, yet may contain different framework sequences from these antibodies.

Such framework sequences can be obtained from public DNA databases or published references that include germline antibody gene sequences. For example, germline DNA sequences for human heavy and light chain variable region genes can be found in the "VBase" human germline sequence database (available on the Internet at www.mrc-cpe.cam.ac.uk/vbase), as well as in Kabat, E. A., et al. (1991) Sequences of Proteins of Immunological Interest, Fifth Edition, U.S. Department of Health and Human Services, NIH Publication No. 91-3242; Tomlinson, I. M., et al. (1992) "The Repertoire of Human Germline $V_H$ Sequences Reveals about Fifty Groups of $V_H$ Segments with Different Hypervariable Loops" J. Mol. Biol. 227:776-798; and Cox, J. P. L. et al. (1994) "A Directory of Human Germ-line $V_H$ Segments Reveals a Strong Bias in their Usage" Eur. J. Immunol. 24:827-836; the contents of each of which are expressly incorporated herein by reference.

Preferred framework sequences for use in the antibodies described herein are those that are structurally similar to the framework sequences used by antibodies described herein. The $V_H$ CDR1, 2 and 3 sequences, and the $V_L$ CDR1, 2 and 3 sequences, can be grafted onto framework regions that have the identical sequence as that found in the germline immunoglobulin gene from which the framework sequence derive, or the CDR sequences can be grafted onto framework regions that contain up to 20, preferably conservative, amino acid substitutions as compared to the germline sequences. For example, it has been found that in certain instances it is beneficial to mutate residues within the framework regions to maintain or enhance the antigen binding ability of the antibody (see e.g., U.S. Pat. Nos. 5,530,101; 5,585,089; 5,693,762 and 6,180,370 to Queen et al).

Engineered antibodies described herein include those in which modifications have been made to framework residues within $V_H$ and/or $V_L$, e.g. to improve the properties of the antibody. Typically such framework modifications are made to decrease the immunogenicity of the antibody. For example, one approach is to "backmutate" one or more framework residues to the corresponding germline sequence. More specifically, an antibody that has undergone somatic mutation may contain framework residues that differ from the germline sequence from which the antibody is derived. Such residues can be identified by comparing the antibody framework sequences to the germline sequences from which the antibody is derived. To return the framework region sequences to their germline configuration, the somatic mutations can be "backmutated" to the germline sequence by, for example, site-directed mutagenesis or PCR-mediated mutagenesis. Such "backmutated" antibodies are also intended to be encompassed. Another type of framework modification involves mutating one or more residues within the framework region, or even within one or more CDR regions, to remove T cell epitopes to thereby reduce the potential immunogenicity of the antibody. This approach is also referred to as "deimmunization" and is described in further detail in U.S. Patent Publication No. 20030153043 by Carr et al.

Another type of variable region modification is to mutate amino acid residues within the CDR regions to improve one or more binding properties (e.g., affinity) of the antibody of interest. Site-directed mutagenesis or PCR-mediated mutagenesis can be performed to introduce the mutation(s) and the effect on antibody binding, or other functional property of interest, can be evaluated in in vitro or in vivo assays as described herein and provided in the Examples. Preferably conservative modifications (as discussed above) are introduced. The mutations may be amino acid additions, deletions, or preferably substitutions. Moreover, typically no more than one, two, three, four or five residues within a CDR region are altered.

Accordingly, also provided are isolated anti-CD73 monoclonal antibodies, or antigen binding portions thereof, comprising a heavy chain variable region comprising: (a) a $V_H$ CDR1 region comprising an amino acid sequence selected from the group consisting of SEQ ID NOs: 5, 17, 33, 41, 53, 61, 69, 81, and 89, or an amino acid sequence having one, two, three, four or five amino acid substitutions, deletions or additions as compared to SEQ ID NOs: 5, 17, 33, 41, 53, 61, 69, 81, and 89; (b) a $V_H$ CDR2 region comprising an amino acid sequence selected from the group consisting of SEQ ID NOs: 6, 18, 34, 42, 54, 62, 70, 82, and 90, or an amino acid sequence having one, two, three, four or five amino acid substitutions, deletions or additions as compared to SEQ ID NOs: 6, 18, 34, 42, 54, 62, 70, 82, and 90; (c) a $V_H$ CDR3 region comprising an amino acid sequence selected from the group consisting of SEQ ID NOs:7, 19, 35, 43, 55, 63, 71, 83, and 91, or an amino acid sequence having one, two, three, four or five amino acid substitutions, deletions or additions as compared to SEQ ID NOs: 7, 19, 35, 43, 55, 63, 71, 83, and 91; (d) a $V_L$ CDR1 region comprising an amino acid sequence selected from the group consisting of SEQ ID NOs: 9, 13, 21, 25, 29, 37, 45, 49, 57, 65, 73, 77, 85, and 93, or an amino acid sequence having one, two, three, four or five amino acid substitutions, deletions or additions as compared to SEQ ID NOs: 9, 13, 21, 25, 29, 37, 45, 49, 57, 65, 73, 77, 85, and 93; (e) a $V_L$ CDR2 region comprising an amino acid sequence selected from the group consisting of SEQ ID NOs: 10, 14, 22, 26, 30, 38, 46, 50, 58, 66, 74, 78, 86, and 94, or an amino acid sequence having one, two, three, four or five amino acid substitutions, deletions or additions as compared to SEQ ID NOs: 10, 14, 22, 26, 30, 38, 46, 50, 58, 66, 74, 78, 86, and 94; and (f) a $V_L$ CDR3 region comprising an amino acid sequence selected from the group consisting of SEQ ID NOs: 11, 15, 23, 27, 31, 39, 47, 51, 59, 67, 75, 79, 87, and 95, or an amino acid sequence having one, two, three, four or five amino acid substitutions, deletions or additions as compared to SEQ ID NOs: 11, 15, 23, 27, 31, 39, 47, 51, 59, 67, 75, 79, 87, and 95.

Methionine residues in CDRs of antibodies can be oxidized, resulting in potential chemical degradation and consequent reduction in potency of the antibody. Accordingly, also provided are anti-CD73 antibodies that have one or more methionine residues in the heavy and/or light chain CDRs replaced with amino acid residues that do not undergo oxidative degradation.

Similarly, deamidation sites may be removed from anti-CD73 antibodies, particularly in the CDRs.

Potential glycosylation sites within the antigen binding domain are preferably eliminated to prevent glycosylation that may interfere with antigen binding. See, e.g., U.S. Pat. No. 5,714,350.

Targeted Antigen Binding

In various embodiments, the antibody of the present invention is modified to selectively block antigen binding in tissues and environments where antigen binding would be detrimental, but allow antigen binding where it would be beneficial. In one embodiment, a blocking peptide "mask" is generated that specifically binds to the antigen binding surface of the antibody and interferes with antigen binding, which mask is linked to each of the binding arms of the antibody by a peptidase cleavable linker. See, e.g., U.S. Pat. No. 8,518,404 to CytomX. Such constructs are useful for treatment of cancers in which protease levels are greatly increased in the tumor microenvironment compared with non-tumor tissues. Selective cleavage of the cleavable linker in the tumor microenvironment allows disassociation of the masking/blocking peptide, enabling antigen binding selectively in the tumor, rather than in peripheral tissues in which antigen binding might cause unwanted side effects.

Alternatively, in a related embodiment, a bivalent binding compound ("masking ligand") comprising two antigen binding domains is developed that binds to both antigen binding surfaces of the (bivalent) antibody and interfere with antigen binding, in which the two binding domains masks are linked to each other (but not the antibody) by a cleavable linker, for example cleavable by a peptidase. See, e.g., Int'l Pat. App. Pub. No. WO 2010/077643 to Tegopharm Corp. Masking ligands may comprise, or be derived from, the antigen to which the antibody is intended to bind, or may be independently generated. Such masking ligands are useful for treatment of cancers in which protease levels are greatly increased in the tumor microenvironment compared with non-tumor tissues. Selective cleavage of the cleavable linker in the tumor microenvironment allows disassociation of the two binding domains from each other, reducing the avidity for the antigen-binding surfaces of the antibody. The resulting dissociation of the masking ligand from the antibody enables antigen binding selectively in the tumor, rather than in peripheral tissues in which antigen binding might cause unwanted side effects.

Fcs and Modified Fcs

In addition to the activity of a therapeutic antibody arising from binding of the antigen binding domain to the antigen (e.g. blocking of a cognate ligand or receptor protein in the case of antagonist antibodies, or induced signaling in the case of agonist antibodies), the Fc portion of the antibody interact with the immune system generally in complex ways to elicit any number of biological effects. Effector functions, such as The Fc region of an immunoglobulin is responsible for many important antibody functions, such as antigen-dependent cellular cytotoxicity (ADCC), complement dependent cytotoxicity (CDC), and antibody-dependent cell-mediated phagocytosis (ADCP), result in killing of target cells, albeit by different mechanisms.

Anti-CD73 antibodies may comprise the variable domains of the antibodies described herein with constant domains comprising different Fc regions, selected based on the biological activities (if any) of the antibody for the intended use. Salfeld (2007) *Nat. Biotechnol.* 25:1369. Human IgGs, for example, can be classified into four subclasses, IgG1, IgG2, IgG3, and IgG4, and each these of these comprises an Fc region having a unique profile for binding to one or more of Fcγ receptors (activating receptors FcγRI (CD64), FcγRIIA, FcγRIIC (CD32); FcγRIIIA and FcγRIIIB (CD16) and inhibiting receptor FcγRIIB), and for the first component of complement (C1q). Human IgG1 and IgG3 bind to all Fcγ receptors; IgG2 binds to FcγRIIA$_{H131}$, and with lower affinity to FcγRIIA$_{R131}$ FcγRIIIA$_{V158}$; IgG4 binds to FcγRI, FcγRIIA, FcγRIIB, FcγRIIC, and FcγRIIIA$_{V158}$; and the inhibitory receptor FcγRIIB has a lower affinity for IgG1, IgG2 and IgG3 than all other Fcγ receptors. Bruhns et al. (2009) *Blood* 113:3716. Studies have shown that FcγRI does not bind to IgG2, and FcγRIIIB does not bind to IgG2 or IgG4. Id. In general, with regard to ADCC activity, human IgG1≧IgG3>>IgG4≧IgG2. As a consequence, for example, an IgG1 constant domain, rather than an IgG2 or IgG4, might be chosen for use in a drug where ADCC is desired; IgG3 might be chosen if activation of FcγRIIIA-expressing NK cells, monocytes of macrophages; and IgG4 might be chosen if the antibody is to be used to desensitize allergy patients. IgG4 may also be selected if it is desired that the antibody lack all effector function.

Accordingly, anti-CD73 variable regions described herein may be linked (e.g., covalently linked or fused) to an Fc, e.g., an IgG1, IgG2, IgG3 or IgG4 Fc, which may be of any allotype or isoallotype, e.g., for IgG1: G1m, G1m1(a), G1m2(x), G1m3(f), G1m17(z); for IgG2: G2m, G2m23(n); for IgG3: G3m, G3m21(g1), G3m28(g5), G3m11(b0), G3m5(b1), G3m13(b3), G3m14(b4), G3m10(b5), G3m15(s), G3m16(t), G3m6(c3), G3m24(c5), G3m26(u), G3m27(v); See, e.g., Jefferis et al. (2009) *mAbs* 1:1). Selection of allotype may be influenced by the potential immunogenicity concerns, e.g. to minimize the formation of anti-drug antibodies.

Variable regions described herein may be linked to an Fc comprising one or more modifications, typically to alter one or more functional properties of the antibody, such as serum half-life, complement fixation, Fc receptor binding, and/or antigen-dependent cellular cytotoxicity. Furthermore, an antibody described herein may be chemically modified (e.g., one or more chemical moieties can be attached to the antibody) or it may be modified to alter its glycosylation, to alter one or more functional properties of the antibody. Each of these embodiments is described in further detail below. The numbering of residues in the Fc region is that of the EU index of Kabat. Sequence variants disclosed herein are provided with reference to the residue number followed by the amino acid that is substituted in place of the naturally occurring amino acid, optionally preceded by the naturally occurring residue at that position. Where multiple amino acids may be present at a given position, e.g. if sequences differ between naturally occurring isotypes, or if multiple mutations may be substituted at the position, they are separated by slashes (e.g. "X/Y/Z").

For example, one may make modifications in the Fc region in order to generate an Fc variant with (a) increased or decreased antibody-dependent cell-mediated cytotoxicity (ADCC), (b) increased or decreased complement mediated cytotoxicity (CDC), (c) increased or decreased affinity for C1q and/or (d) increased or decreased affinity for a Fc receptor relative to the parent Fc, Such Fc region variants will generally comprise at least one amino acid modification in the Fc region. Combining amino acid modifications is thought to be particularly desirable. For example, the variant Fc region may include two, three, four, five, etc substitutions therein, e.g. of the specific Fc region positions identified herein. Exemplary Fc sequence variants are disclosed herein, and are also provided at U.S. Pat. Nos. 5,624,821; 6,277,375; 6,737,056; 6,194,551; 7,317,091; 8,101,720;

PCT Patent Publications WO 00/42072; WO 01/58957; WO 04/016750; WO 04/029207; WO 04/035752; WO 04/074455; WO 04/099249; WO 04/063351; WO 05/070963; WO 05/040217, WO 05/092925 and WO 06/020114.

Reducing Effector Function

ADCC activity may be reduced by modifying the Fc region. In certain embodiments, sites that affect binding to Fc receptors may be removed, preferably sites other than salvage receptor binding sites. In other embodiments, an Fc region may be modified to remove an ADCC site. ADCC sites are known in the art; see, for example, Sarmay et at (1992) *Molec. Immunol.* 29 (5): 633-9 with regard to ADCC sites in IgG1. In one embodiment, the G236R and L328R variant of human IgG1 effectively eliminates FcγR binding. Horton et al. (2011) *J. Immunol.* 186:4223 and Chu et al. (2008) *Mol. Immunol.* 45:3926. In other embodiments, the Fc having reduced binding to FcγRs comprised the amino acid substitutions L234A, L235E and G237A. Gross et al. (2001) *Immunity* 15:289.

CDC activity may also be reduced by modifying the Fc region. Mutations at IgG1 positions D270, K322, P329 and P331, specifically alanine mutations D270A, K322A, P329A and P331A, significantly reduce the ability of the corresponding antibody to bind C1q and activate complement. Idusogie et al. (2000) *J. Immunol.* 164:4178; WO 99/51642. Modification of position 331 of IgG1 (e.g. P331S) has been shown to reduce complement binding. Tao et al. (1993) *J. Exp. Med.* 178:661 and Canfield & Morrison (1991) *J. Exp. Med.* 173:1483. In another example, one or more amino acid residues within amino acid positions 231 to 239 are altered to thereby reduce the ability of the antibody to fix complement. WO 94/29351.

In some embodiments, the Fc with reduced complement fixation has the amino acid substitutions A330S and P331S. Gross et al. (2001) *Immunity* 15:289.

For uses where effector function is to be avoided altogether, e.g. when antigen binding alone is sufficient to generate the desired therapeutic benefit, and effector function only leads to (or increases the risk of) undesired side effects, IgG4 antibodies may be used, or antibodies or fragments lacking the Fc region or a substantial portion thereof can be devised, or the Fc may be mutated to eliminate glycosylation altogether (e.g. N297A). Alternatively, a hybrid construct of human IgG2 ($C_H1$ domain and hinge region) and human IgG4 ($C_H2$ and $C_H3$ domains) has been generated that is devoid of effector function, lacking the ability to bind the FcγRs (like IgG2) and unable to activate complement (like IgG4). Rother et al. (2007) *Nat. Biotechnol.* 25:1256. See also Mueller et al. (1997) *Mol. Immunol.* 34:441; Labrijn et al. (2008) *Curr. Op. Immunol.* 20:479 (discussing Fc modifications to reduce effector function generally).

In other embodiments, the Fc region is altered by replacing at least one amino acid residue with a different amino acid residue to reduce all effector function(s) of the antibody. For example, one or more amino acids selected from amino acid residues 234, 235, 236, 237, 297, 318, 320 and 322 can be replaced with a different amino acid residue such that the antibody has decreased affinity for an effector ligand but retains the antigen-binding ability of the parent antibody. The effector ligand to which affinity is altered can be, for example, an Fc receptor (residues 234, 235, 236, 237, 297) or the C1 component of complement (residues 297, 318, 320, 322). U.S. Pat. Nos. 5,624,821 and 5,648,260, both by Winter et al.

WO 88/007089 proposed modifications in the IgG Fc region to decrease binding to FcγRI to decrease ADCC (234A; 235E; 236A; G237A) or block binding to complement component C1q to eliminate CDC (E318A or V/K320A and K322A/Q). See also Duncan & Winter (1988) *Nature* 332:563; Chappel et al. (1991) *Proc. Nat'l Acad. Sci. (USA)* 88:9036; and Sondermann et al. (2000) *Nature* 406: 267 (discussing the effects of these mutations on FcγRIII binding).

Fc modifications reducing effector function also include substitutions, insertions, and deletions at positions 234, 235, 236, 237, 267, 269, 325, and 328, such as 234G, 235G, 236R, 237K, 267k, 269R, 325L, and 328R. An Fc variant may comprise 236R/328R. Other modifications for reducing FcγR and complement interactions include substitutions 297A, 234A, 235A, 237A, 318A, 228P, 236E, 268Q, 309L, 330S, 331 S, 220S, 226S, 229S, 238S, 233P, and 234V. These and other modifications are reviewed in Strohl (2009) *Current Opinion in Biotechnology* 20:685-691. Effector functions (both ADCC and complement activation) can be reduced, while maintaining neonatal FcR binding (maintaining half-life), by mutating IgG residues at one or more of positions 233-236 and 327-331, such as E233P, L234V, L235A, optionally G236Δ, A327G, A330S and P331S in IgG1; E233P, F234V, L235A, optionally G236Δ in IgG4; and A330S and P331S in IgG2. See Armour et al. (1999) *Eur. J. Immunol.* 29:2613; WO 99/58572. Other mutations that reduce effector function include L234A and L235A in IgG1 (Alegre et al. (1994) *Transplantation* 57:1537); V234A and G237A in IgG2 (Cole et al. (1997) *J. Immunol.* 159:3613; see also U.S. Pat. No. 5,834,597); and S228P and L235E for IgG4 (Reddy et al. (2000) *J. Immunol.* 164:1925). Another combination of mutations for reducing effector function in a human IgG1 include L234F, L235E and P331S. Oganesyan et al. (2008) *Acta Crystallogr. D. Biol. Crystallogr.* 64:700. See generally Labrijn et gal. (2008) *Curr. Op. Immunol.* 20:479. Additional mutations found to decrease effector function in the context of an Fc (IgG1) fusion protein (abatacept) are C226S, C229S and P238S (EU residue numbering). Davis et al. (2007) *J. Immunol.* 34:2204.

Other Fc variants having reduced ADCC and/or CDC are disclosed at Glaesner et al. (2010) *Diabetes Metab. Res. Rev.* 26:287 (F234A and L235A to decrease ADCC and ADCP in an IgG4); Hutchins et al. (1995) *Proc. Nat'l Acad. Sci.* (USA) 92:11980 (F234A, G237A and E318A in an IgG4); An et al. (2009) *MAbs* 1:572 and U.S. Pat. App. Pub. 2007/0148167 (H268Q, V309L, A330S and P331S in an IgG2); McEarchern et al. (2007) *Blood* 109:1185 (C226S, C229S, E233P, L234V, L235A in an IgG1); Vafa et al. (2014) *Methods* 65:114 (V234V, G237A, P238S, H268A, V309L, A330S, P331S in an IgG2).

In certain embodiments, an Fc is chosen that has essentially no effector function, i.e., it has reduced binding to FcγRs and reduced complement fixation. An exemplary Fc, e.g., IgG1 Fc, that is effectorless comprises the following five mutations: L234A, L235E, G237A, A330S and P331S. Gross et al. (2001) *Immunity* 15:289. Exemplary heavy chains comprising these mutations are set forth in the Sequence Listing, as detailed at Table 35. These five substitutions may be combined with N297A to eliminate glycosylation as well.

Enhancing Effector Function

Alternatively, ADCC activity may be increased by modifying the Fc region. With regard to ADCC activity, human IgG1≥IgG3>>IgG4≥IgG2, so an IgG1 constant domain, rather than an IgG2 or IgG4, might be chosen for use in a drug where ADCC is desired. Alternatively, the Fc region may be modified to increase antibody dependent cellular cytotoxicity (ADCC) and/or to increase the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285, 286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. See WO 2012/142515; see also WO 00/42072. Exemplary substitutions include 236A, 239D, 239E, 268D, 267E, 268E, 268F, 324T, 332D), and 332E. Exemplary variants include 2:39D/332E, 236A/332E, 236A/239D/332E, 268F/324T, 267E/268F, 267E/324T, and 267E/268F/324T. For example, human IgG1Fcs comprising the G236A variant, which can optionally be combined with I332E, have been shown to increase the FcγIIA/FcγIIB binding affinity ratio approximately 15-fold. Richards et al. (2008) *Mol. Cancer Therap.* 7:2517; Moore et al. (2010) *mAbs* 2:181. Other modifications for enhancing FcγR and complement interactions include but are not limited to substitutions 298A, 333A, 334A, 326A, 247I, 339D, 339Q, 280H, 290S, 298D, 298V, 243L, 292P, 300L, 396L, 305I, and 396L. These and other modifications are reviewed in Strohl (2009) *Current Opinion in Biotechnology* 20:685-691. Specifically, both ADCC and CDC may be enhanced by changes at position E333 of IgG1, e.g. E333A. Shields et al. (2001) *J. Biol. Chem.* 276:6591, The use of P247I and A339D/Q mutations to enhance effector function in an IgG1 is disclosed at WO 2006/020114, and D280H, K290S±S298D/V is disclosed at WO 2004/074455. The K326A/W and E333A/S variants have been shown to increase effector function in human IgG1, and E333S in IgG2. Idusogie et al. (2001) *J. Immunol.* 166:2571.

Specifically, the binding sites on human IgG1 for FcγR1, FcγRII, FcγRIII and FcRn have been mapped, and variants with improved binding have been described. Shields et al. (2001) *J. Biol. Chem.* 276:6591-6604. Specific mutations at positions 256, 290, 298, 333, 334 and 339 were shown to improve binding to FcγRIII, including the combination mutants T256A/S298A, S298A/E333A, S298A/K224A and S298A/E333A/K334A (having enhanced FcγRIIIa binding and ADCC activity). Other IgG1 variants with strongly enhanced binding to FcγRIIIa have been identified, including variants with S239D/I332E and S239D/I332E/A330L mutations which showed the greatest increase in affinity for FcγRIIIa, a decrease in FcγRIIB binding, and strong cytotoxic activity in cynomolgus monkeys. Lazar et al. (2006) *Proc. Nat'l Acad Sci.* (*USA*) 103:4005; Awan et al. (2010) *Blood* 115:1204; Desjarlais & Lazar (2011) *Exp. Cell Res.* 317:1278. Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/I332E variant showed an enhanced capacity to deplete B cells in monkeys. Lazar et al. (2006) *Proc. Nat'l Acad Sci.* (*USA*) 103:4005. In addition, IgG1 mutants containing L235V, F243L, R292P, Y300L, V305I and P396L mutations which exhibited enhanced binding to FcγRIIIa and concomitantly enhanced ADCC activity in transgenic mice expressing human FcγRIIIa in models of B cell malignancies and breast cancer have been identified. Stavenhagen et al. (2007) *Cancer Res.* 67:8882; U.S. Pat. No. 8,652,466; Nordstrom et al. (2011) *Breast Cancer Res.* 13:R123.

Different IgG isotypes also exhibit differential CDC activity (IgG3>IgG1>>IgG2≈IgG4). Dangl et al. (1988) *EMBO J.* 7:1989. For uses in which enhanced CDC is desired, it is also possible to introduce mutations that increase binding to C1q. The ability to recruit complement (CDC) may be enhanced by mutations at K326 and/or E333 in an IgG2, such as K326W (which reduces ADCC activity) and E333S, to increase binding to C1q, the first component of the complement cascade. Idusogie et al. (2001) *J. Immunol.* 166:2571. Introduction of S267E/H268F/S324T (alone or in any combination) into human IgG1 enhances C1q binding. Moore et al. (2010) *mAbs* 2:181. The Fc region of the IgG1/IgG3 hybrid isotype antibody "113F" of Natsume et al. (2008) *Cancer Res.* 68:3863 (FIG. 1 therein) also confers enhanced CDC. See also Michaelsen et al. (2009) *Scand. J. Immunol.* 70:553 and Redpath et al. (1998) *Immunology* 93:595.

Additional mutations that can increase or decrease effector function are disclosed at Dall'Acqua et al. (2006) *J. Immunol.* 177:1129. See also Carter (2006) *Nat. Rev. Immunol.* 6:343; Presta (2008) *Curr. Op. Immunol.* 20:460.

Fc variants that enhance affinity for the inhibitory receptor FcγRIIb may also be used, e.g. to enhance apoptosis-inducing or adjuvant activity. Li & Ravetch (2011) *Science* 333:1030; Li & Ravetch (2012) *Proc. Nat'l Acad. Sci* (*USA*) 109:10966; U.S. Pat. App. Pub. 2014/0010812. Such variants may provide an antibody with immunomodulatory activities related to FcγRIIb+ cells, including for example B cells and monocytes. In one embodiment, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, and 332, according to the EU index. Exemplary substitutions for enhancing FcγRIIb affinity include but are not limited to 234D, 234E, 234F, 234W, 235D, 235F, 235R, 235Y, 236D, 236N, 237D, 237N, 239D, 239E, 266M, 267D, 267E, 268D, 268E, 327D, 327E, 328F, 328W, 328Y, and 332E. Exemplary substitutions include 235Y, 236D, 239D, 266M, 267E, 268D, 268E, 328F, 328W, and 328Y. Other Fc variants for enhancing binding to FcγRIIb include 235Y/267E, 236D/267E, 239D/268D, 239D/267E, 267E/268D, 267E/268E, and 267E/328F. Specifically, the S267E, G236D, S239D, L328F and I332E variants, including the S267E+L328F double variant, of human IgG1 are of particular value in specifically enhancing affinity for the inhibitory FcγRIIb receptor. Chu et al. (2008) *Mol. Immunol.* 45:3926; U.S. Pat. App. Pub. 2006/024298; WO 2012/087928. Enhanced specificity for FcγRIIb (as distinguished from FcγRIIa$^{R131}$) may be obtained by adding the P238D substitution. Mimoto et al. (2013) *Protein. Eng. Des. & Selection* 26:589; WO 2012/115241.

In certain embodiments, the antibody is modified to increase its biological half-life. Various approaches are possible. For example, this may be done by increasing the binding affinity of the Fc region for FcRn. In one embodiment, the antibody is altered within the CH1 or CL region to contain a salvage receptor binding epitope taken from two loops of a CH2 domain of an Fc region of an IgG, as described in U.S. Pat. Nos. 5,869,046 and 6,121,022 by Presta et al. Other exemplary Fc variants that increase binding to FcRn and/or improve pharmacokinetic properties include substitutions at positions 259, 308, and 434, including for example 259I, 308F, 428L, 428M, 4345, 434H, 434F, 434Y, and 434M. Other variants that increase Fc binding to FcRn include: 250E, 250Q, 428L, 428F, 250Q/428L (Hinton et al., 2004, *J. Biol. Chem.* 279(8): 6213-6216, Hinton et al. 2006 Journal of immunology 176:346-356), 256A, 272A, 305A, 307A, 311A, 312A, 378Q, 380A, 382A, 434A (Shields et al, Journal of Biological Chemistry, 2001, 276 (9):6591-6604), 252F, 252Y, 252W, 254I, 256Q, 256E, 256D, 433R, 434F, 434Y, 252Y/254T/256E, 433K/434F/ 436H (Dall Acqua et al. Journal of Immunology, 2002, 169:5171-5180, Dall'Acqua et al., 2006, Journal of Biological Chemistry 281:23514-23524). See U.S. Pat. No. 8,367,805.

Modification of certain conserved residues in IgG Fc (I253/H310/Q311/H433/N434), such as the N434A variant (Young et al. (2009) *J. Immunol.* 182:7663), has been proposed as a way to increase FcRn affinity, thus increasing the half-life of the antibody in circulation. WO 98/023289. The combination Fc variant comprising M428L and N434S has been shown to increase FeRn binding and increase serum half-life up to five-fold. Zalevsky et al. (2010) *Nat. Biotechnol.* 28:157. The combination Fc variant comprising T307A, E380A and N434A modifications also extends half-life of IgG1 antibodies. Petkova et al. (2006) *Int. Immunol.* 18:1759. In addition, combination Fc variants comprising M252Y/M428L, M428L/N434H, M428L/N434F, M428L/N434Y, M428L/N434A, M428L/N434M, and M428L/N434S variants have also been shown to extend half-life. WO 2009/086320.

Further, a combination Fc variant comprising M252Y, S254T and T256E, increases half-life-nearly 4-fold. Dall'Acqua et al. (2006) *J. Biol. Chem.* 281:23514. A related IgG1 modification providing increased FcRn affinity but reduced pH dependence (M252Y/S254T/T256E/H433K/N434F) has been used to create an IgG1 construct ("MST-HN Abdeg") for use as a competitor to prevent binding of other antibodies to FcRn, resulting in increased clearance of that other antibody, either endogenous IgG (e.g. in an autoimmune setting) or another exogenous (therapeutic) mAb. Vaccaro et al. (2005) *Nat. Biotechnol.* 23:1283; WO 2006/130834.

Other modifications for increasing FcRn binding are described in Young et al. (2010) *J. Immunol.* 182:7663-7671; U.S. Pat. Nos. 6,277,375; 6,821,505; WO 97/34631; WO 2002/060919.

In certain embodiments, hybrid IgG isotypes may be used to increase FcRn binding, and potentially increase half-life. For example, an IgG1/IgG3 hybrid variant may be constructed by substituting IgG1 positions in the CH2 and/or CH3 region with the amino acids from IgG3 at positions where the two isotypes differ. Thus a hybrid variant IgG antibody may be constructed that comprises one or more substitutions, e.g., 274Q, 276K, 300F, 339T, 356E, 358M, 384S, 392N, 397M, 422I, 435R, and 436F. In other embodiments described herein, an IgG1/IgG2 hybrid variant may be constructed by substituting IgG2 positions in the CH2 and/or CH3 region with amino acids from IgG1 at positions where the two isotypes differ. Thus a hybrid variant IgG antibody may be constructed that comprises one or more substitutions, e.g., one or more of the following amino acid substitutions: 233E, 234L, 235L, -236G (referring to an insertion of a glycine at position 236), and 327A. See U.S. Pat. No. 8,629,113. A hybrid of IgG1/IgG2/IgG4 sequences has been generated that purportedly increases serum half-life and improves expression. U.S. Pat. No. 7,867,491 (sequence number 18 therein).

The serum half-life of the antibodies of the present invention can also be increased by pegylation. An antibody can be pegylated to, for example, increase the biological (e.g., serum) half-life of the antibody. To pegylate an antibody, the antibody, or fragment thereof, typically is reacted with a polyethylene glycol (PEG) reagent, such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (C1-C10) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies described herein. See for example, EP 0154316 by Nishimura et al. and EP 0401384 by Ishikawa et al.

Alternatively, under some circumstances it may be desirable to decrease the half-life of an antibody of the present invention, rather than increase it. Modifications such as I253A (Hornick et al. (2000) *J. Nucl. Med.* 41:355) and H435A/R I253A or H310A (Kim et al. (2000) *Eur. J. Immunol.* 29:2819) in Fc of human IgG1 can decrease FcRn binding, thus decreasing half-life (increasing clearance) for use in situations where rapid clearance is preferred, such a medical imaging. See also Kenanova et al. (2005) *Cancer Res.* 65:622. Other means to enhance clearance include formatting the antigen binding domains of the present invention as antibody fragments lacking the ability to bind FcRn, such as Fab fragments. Such modification can reduce the circulating half-life of an antibody from a couple of weeks to a matter of hours. Selective PEGylation of antibody fragments can then be used to fine-tune (increase) the half-life of the antibody fragments if necessary. Chapman et al. (1999) *Nat. Biotechnol.* 17:780. Antibody fragments may also be fused to human serum albumin, e.g. in a fusion protein construct, to increase half-life. Yeh et al. (1992) *Proc. Nat'l Acad. Sci.* 89:1904. Alternatively, a bispecific antibody may be constructed with a first antigen binding domain of the present invention and a second antigen binding domain that binds to human serum albumin (HSA). See Int'l Pat. Appl. Pub. WO 2009/127691 and patent references cited therein. Alternatively, specialized polypeptide sequences can be added to antibody fragments to increase half-life, e.g. "XTEN" polypeptide sequences. Schellenberger et al. (2009) *Nat. Biotechnol.* 27:1186; Int'l Pat. Appl. Pub. WO 2010/091122. Additional Fc Variants When using an IgG4 constant domain, it is usually preferable to include the substitution S228P, which mimics the hinge sequence in IgG1 and thereby stabilizes IgG4 molecules, e.g. reducing Fab-arm exchange between the therapeutic antibody and endogenous IgG4 in the patient being treated. Labrijn et al. (2009) *Nat. Biotechnol.* 27:767; Reddy et al. (2000) *J. Immunol.* 164:1925.

A potential protease cleavage site in the hinge of IgG1 constructs can be eliminated by D221G and K222S modifications, increasing the stability of the antibody. WO 2014/043344.

The affinities and binding properties of an Fc variant for its ligands (Fc receptors) may be determined by a variety of in vitro assay methods (biochemical or immunological based assays) known in the art including but not limited to, equilibrium methods (e.g., enzyme-linked immunoabsorbent assay (ELISA), or radioimmunoassay (RIA)), or kinetics (e.g., BIACORE® SPR analysis), and other methods such as indirect binding assays, competitive inhibition assays, fluorescence resonance energy transfer (FRET), gel electrophoresis and chromatography (e.g., gel filtration).

These and other methods may utilize a label on one or more of the components being examined and/or employ a variety of detection methods including but not limited to chromogenic, fluorescent, luminescent, or isotopic: labels. A detailed description of binding affinities and kinetics can be found in Paul, W. E., ed., Fundamental Immunology, 4th Ed., Lippincott-Raven, Philadelphia (1999), which focuses on antibody-immunogen interactions.

In still other embodiments, the glycosylation of an antibody is modified to increase or decrease effector function. For example, an aglycoslated antibody can be made that lacks all effector function by mutating the conserved asparagine residue at position 297 (e.g. N297A), thus abolishing complement and FcγRI binding. Bolt et al. (1993) *Eur. J. Immunol.* 23:403. See also Tao & Morrison (1989) *J. Immunol.* 143:2595 (using N297Q in IgG1 to eliminate glycosylation at position 297).

Although aglycosylated antibodies generally lack effector function, mutations can be introduced to restore that function. Aglycosylated antibodies, e.g. those resulting from N297A/C/D/or H mutations or produced in systems (e.g. *E. coli*) that do not glycosylate proteins, can be further mutated to restore FcγR binding, e.g. S298G and/or T299A/G/or H (WO 2009/079242), or E382V and M428I (Jung et al. (2010) *Proc. Nat'l Acad. Sci (USA)* 107:604).

Additionally, an antibody with enhanced ADCC can be made by altering the glycosylation. For example, removal of fucose from heavy chain Asn297-linked oligosaccharides has been shown to enhance ADCC, based on improved binding to FcγRIIIa. Shields et al. (2002) *JBC* 277:26733; Niwa et al. (2005) *J. Immunol. Methods* 306: 151; Cardarelli et al. (2009) *Clin. Cancer Res.* 15:3376 (MDX-1401); Cardarelli et al. (2010) *Cancer Immunol. Immunotherap.* 59:257 (MDX-1342). Such low fucose antibodies may be produced, e.g., in knockout Chinese hamster ovary (CHO) cells lacking fucosyltransferase (FUT8) (Yamane-Ohnuki et al. (2004) *Biotechnol. Bioeng.* 87:614), or in other cells that generate afucosylated antibodies. See, e.g., Zhang et al. (2011) *mAbs* 3:289 and Li et al. (2006) *Nat. Biotechnol.* 24:210 (both describing antibody production in glycoengineered *Pichia pastoris.*); Mossner et al. (2010) *Blood* 115: 4393; Shields et al. (2002) *J. Biol. Chem.* 277:26733; Shinkawa et al. (2003) *J. Biol. Chem.* 278:3466; EP 1176195B1. ADCC can also be enhanced as described in PCT Publication WO 03/035835, which discloses use of a variant CHO cell line, Lec13, with reduced ability to attach fucose to Asn(297)-linked carbohydrates, also resulting in hypofucosylation of antibodies expressed in that host cell (see also Shields, R. L. et al. (2002) *J. Biol. Chem.* 277: 26733-26740). Alternatively, fucose analogs may be added to culture medium during antibody production to inhibit incorporation of fucose into the carbohydrate on the antibody. WO 2009/135181.

Increasing bisecting GlcNac structures in antibody-linked oligosaccharides also enhances ADCC. PCT Publication WO 99/54342 by Umana et al. describes cell lines engineered to express glycoprotein-modifying glycosyl transferases (e.g., beta(1,4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) *Nat. Biotech.* 17:176-180).

Additional glycosylation variants have been developed that are devoid of galactose, sialic acid, fucose and xylose residues (so-called GNGN glycoforms), which exhibit enhanced ADCC and ADCP but decreased CDC, as well as others that are devoid of sialic acid, fucose and xylose (so-called G1/G2 glycoforms), which exhibit enhanced ADCC, ADCP and CDC. U.S. Pat. App. Pub. No. 2013/0149300. Antibodies having these glycosylation patterns are optionally produced in genetically modified *N. benthamiana* plants in which the endogenous xylosyl and fucosyl transferase genes have been knocked-out.

Glycoengineering can also be used to modify the anti-inflammatory properties of an IgG construct by changing the α2,6 sialyl content of the carbohydrate chains attached at Asn297 of the Fc regions, wherein an increased proportion of α2,6 sialylated forms results in enhanced anti-inflammatory effects. See Nimmerjahn et al. (2008) *Ann. Rev. Immunol.* 26:513. Conversely, reduction in the proportion of antibodies having α2,6 sialylated carbohydrates may be useful in cases where anti-inflammatory properties are not wanted. Methods of modifying α2,6 sialylation content of antibodies, for example by selective purification of α2,6 sialylated forms or by enzymatic modification, are provided at U.S. Pat. Appl. Pub. No. 2008/0206246. In other embodiments, the amino acid sequence of the Fc region may be modified to mimic the effect of α2,6 sialylation, for example by inclusion of an F241A modification. WO 2013/095966.

VIII. Antibody Physical Properties

Antibodies described herein can contain one or more glycosylation sites in either the light or heavy chain variable region. Such glycosylation sites may result in increased immunogenicity of the antibody or an alteration of the pK of the antibody due to altered antigen binding (Marshall et al (1972) *Annu Rev Biochem* 41:673-702; Gala and Morrison (2004) *J. Immunol* 172:5489-94; Wallick et al (1988) *J Exp Med* 168:1099-109; Spiro (2002) *Glycobiology* 12:43R-56R; Parekh et al (1985) *Nature* 316:452-7; Mimura et al. (2000) *Mol Immunol* 37:697-706). Glycosylation has been known to occur at motifs containing an N-X-S/T sequence. In some instances, it is preferred to have an anti-CD73 antibody that does not contain variable region glycosylation. This can be achieved either by selecting antibodies that do not contain the glycosylation motif in the variable region or by mutating residues within the glycosylation region.

In certain embodiments, the antibodies described herein do not contain asparagine isomerism sites. The deamidation of asparagine may occur on N-G or D-G sequences and may result in the creation of an isoaspartic acid residue that may introduce a kink into the polypeptide chain and may decrease its stability (isoaspartic acid effect). For instance, if the amino acid sequence Asp-Gly is present in the heavy and/or light chain CDR sequences of the antibody, the sequence is substituted with an amino acid sequence that does not undergo isomerization. In one embodiment, the antibody comprises the heavy chain variable region CDR2 sequence set forth in SEQ ID NO: 6, but wherein the Asp or Gly in the Asp-Gly sequence (VILYDGSNKYYPDSVKG; SEQ ID NO: 6) is replaced with an amino acid sequence that does not undergo isomerization, for example, an Asp-Ser or a Ser-Gly sequence.

Each antibody will have a unique isoelectric point (pI), which generally falls in the pH range between 6 and 9.5. The pI for an IgG1 antibody typically falls within the pH range of 7-9.5 and the pI for an IgG4 antibody typically falls within the pH range of 6-8. There is speculation that antibodies with a pI outside the normal range may have some unfolding and instability under in vivo conditions. Thus, it is preferred to have an anti-CD73 antibody that contains a pI value that falls in the normal range. This can be achieved either by selecting antibodies with a pI in the normal range or by mutating charged surface residues.

Each antibody will have a characteristic melting temperature, with a higher melting temperature indicating greater overall stability in vivo (Krishnamurthy R and Manning M C (2002) *Curr Pharm Biotechnol* 3:361-71). Generally, it is preferred that the $T_{M1}$ (the temperature of initial unfolding) be greater than 60° C., preferably greater than 65° C., even more preferably greater than 70° C. The melting point of an antibody can be measured using differential scanning calorimetry (Chen et al (2003) *Pharm Res* 20:1952-60; Ghirlando et al (1999) *Immunol Lett* 68:47-52) or circular dichroism (Murray et al. (2002) *J. Chromatogr Sci* 40:343-9). In a preferred embodiment, antibodies are selected that do not degrade rapidly. Degradation of an antibody can be measured using capillary electrophoresis (CE) and MALDI-MS (Alexander A J and Hughes D E (1995) *Anal Chem* 67:3626-32).

In another preferred embodiment, antibodies are selected that have minimal aggregation effects, which can lead to the triggering of an unwanted immune response and/or altered or unfavorable pharmacokinetic properties. Generally, antibodies are acceptable with aggregation of 25% or less, preferably 20% or less, even more preferably 15% or less, even more preferably 10% or less and even more preferably 5% or less. Aggregation can be measured by several techniques, including size-exclusion column (SEC), high performance liquid chromatography (HPLC), and light scattering.

IX. Methods of Engineering Antibodies

As discussed above, the anti-CD73 antibodies having $V_H$ and $V_L$ sequences disclosed herein can be used to create new anti-CD73 antibodies by modifying the VH and/or VL sequences, or the constant region(s) attached thereto. Thus, in another aspect described herein, the structural features of an anti-CD73 antibody described herein, e.g. CD73.4, 11F11, 4C3, 4D4, 10D2, 11A6, 24H2, 5F8, 6E11 and/or 7A11, are used to create structurally related anti-CD73 antibodies that retain at least one functional property of the antibodies described herein, such as binding to human CD73 and cynomolgus CD73. For example, one or more CDR regions of 11F11, 4C3, 4D4, 10D2, 11A6, 24H2, 5F8, 6E11 and/or 7A11, or mutations thereof, can be combined recombinantly with known framework regions and/or other CDRs to create additional, recombinantly-engineered, anti-CD73 antibodies described herein, as discussed above. Other types of modifications include those described in the previous section. The starting material for the engineering method is one or more of the $V_H$ and/or $V_L$ sequences provided herein, or one or more CDR regions thereof. To create the engineered antibody, it is not necessary to actually prepare (i.e., express as a protein) an antibody having one or more of the $V_H$ and/or $V_L$ sequences provided herein, or one or more CDR regions thereof. Rather, the information contained in the sequence(s) is used as the starting material to create a "second generation" sequence(s) derived from the original sequence(s) and then the "second generation" sequence(s) is prepared and expressed as a protein.

Accordingly, provided herein are methods for preparing an anti-CD73 antibody comprising:

(a) providing: (i) a heavy chain variable region antibody sequence comprising a CDR1 sequence selected from the group consisting of SEQ ID NOs: 5, 17, 33, 41, 53, 61, 69, 81, and 89, a CDR2 sequence selected from the group consisting of SEQ ID NOs: 6, 18, 34, 42, 54, 62, 70, 82, and 90, and/or a CDR3 sequence selected from the group consisting of SEQ ID NOs: 7, 19, 35, 43, 55, 63, 71, 83, and 91; and (ii) a light chain variable region antibody sequence comprising a CDR1 sequence selected from the group consisting of SEQ ID NOs: 9, 13, 21, 25, 29, 37, 45, 49, 57, 65, 73, 77, 85, and 93, a CDR2 sequence selected from the group consisting of SEQ ID NOs: 10, 14, 22, 26, 30, 38, 46, 50, 58, 66, 74, 78, 86, and 94, and/or a CDR3 sequence selected from the group consisting of SEQ ID NOs: 11, 15, 23, 27, 31, 39, 47, 51, 59, 67, 75, 79, 87, and 95;

(b) altering at least one amino acid residue within the heavy chain variable region antibody sequence and/or the light chain variable region antibody sequence to create at least one altered antibody sequence; and (c) expressing the altered antibody sequence as a protein.

Standard molecular biology techniques can be used to prepare and express the altered antibody sequence.

Preferably, the antibody encoded by the altered antibody sequence(s) is one that retains one, some or all of the functional properties of the anti-CD73 antibodies described herein, which include those listed in Table 3.

The altered antibody may exhibit one or more, two or more, three or more, four or more, five or more, six or more, seven or more, eight or more, nine or more, ten, or all of the functional properties using the functional assays described herein. The functional properties of the altered antibodies can be assessed using standard assays available in the art and/or described herein, such as those set forth in the Examples (e.g., ELISAs, FACS).

In certain embodiments of the methods of engineering antibodies described herein, mutations can be introduced randomly or selectively along all or part of an anti-CD73 antibody coding sequence and the resulting modified anti-CD73 antibodies can be screened for binding activity and/or other functional properties as described herein. Mutational methods have been described in the art. For example, PCT Publication WO 02/092780 by Short describes methods for creating and screening antibody mutations using saturation mutagenesis, synthetic ligation assembly, or a combination thereof. Alternatively, PCT Publication WO 03/074679 by Lazar et al. describes methods of using computational screening methods to optimize physiochemical properties of antibodies.

X. Nucleic Acid Molecules

Another aspect described herein pertains to nucleic acid molecules that encode the antibodies described herein. The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids (e.g., other chromosomal DNA, e.g., the chromosomal DNA that is linked to the isolated DNA in nature) or proteins, by standard techniques, including alkaline/SDS treatment, CsCl banding, column chromatography, restriction enzymes, agarose gel electrophoresis and others well known in the art. See, F. Ausubel, et al., ed. (1987) Current Protocols in Molecular Biology, Greene Publishing and Wiley Interscience, New York. A nucleic acid described herein can be, for example, DNA or RNA and may or may not contain intronic sequences. In a certain embodiments, the nucleic acid is a cDNA molecule.

Nucleic acids described herein can be obtained using standard molecular biology techniques. For antibodies expressed by hybridomas (e.g., hybridomas prepared from transgenic mice carrying human immunoglobulin genes as described further below), cDNAs encoding the light and heavy chains of the antibody made by the hybridoma can be obtained by standard PCR amplification or cDNA cloning techniques. For antibodies obtained from an immunoglobulin gene library (e.g., using phage display techniques), nucleic acid encoding the antibody can be recovered from the library.

Preferred nucleic acids molecules described herein are those encoding the VH and VL sequences of the anti-CD73 antibodies described herein, e.g., CD73.4 11F11-1, 11F11-2, 4C3-1, 4C3-2, 4C3-3, 4D4, 10D2-1, 10D2-2, 11A6, 24H2, 5F8-1, 5F8-2, 6E11, 7A11, CD73.3 and/or CD73.4 monoclonal antibodies. DNA sequences encoding the VH sequences of CD73.4 (CD73.4-1 and CD73.4-2) 11F11 (11F11-1 and 11F11-2), 4C3 (4C3-1, 4C3-2 and 4C3- 3), 4D4, 10D2 (10D2-1 and 10D2-2), 11A6, 24H2, 5F8 (5F8-1 and 5F8-2), 6E11, 7A11, CD73.3 and CD73.4 are set forth in SEQ ID NOs: 4, 16, 32, 40, 52, 60, 68, 80, 88, 135, and 170, respectively. DNA sequences encoding the VL sequences of 11F11-1, 11F11-2, 4C3-1, 4C3-2, 4C3-3, 4D4, 10D2-1, 10D2-2, 11A6, 24H2, 5F8-1, 5F8-2, 6E11 7A11, CD73.3 and/or CD73.4 are set forth in SEQ ID NOs: 8, 12, 20, 24, 28, 36, 44, 48, 56, 64, 72, 76, 84, and 92, respectively.

Once DNA fragments encoding VH and VL segments are obtained, these DNA fragments can be further manipulated by standard recombinant DNA techniques, for example to convert the variable region genes to full-length antibody chain genes, to Fab fragment genes or to a scFv gene. In these manipulations, a VL- or VH-encoding DNA fragment is operatively linked to another DNA fragment encoding another protein, such as an antibody constant region or a flexible linker. The term "operatively linked", as used in this context, is intended to mean that the two DNA fragments are joined such that the amino acid sequences encoded by the two DNA fragments remain in-frame.

The isolated DNA encoding the VH region can be converted to a full-length heavy chain gene by operatively linking the VH-encoding DNA to another DNA molecule encoding heavy chain constant regions (hinge, CH1, CH2 and/or CH3). The sequences of human heavy chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The heavy chain constant region can be an IgG1, IgG2, IgG3, IgG4, IgA, IgE, IgM or IgD constant region, for example, an IgG1 region. For a Fab fragment heavy chain gene, the VH-encoding DNA can be operatively linked to another DNA molecule encoding only the heavy chain CH1 constant region.

The isolated DNA encoding the VL region can be converted to a full-length light chain gene (as well as a Fab light chain gene) by operatively linking the VL-encoding DNA to another DNA molecule encoding the light chain constant region, CL. The sequences of human light chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The light chain constant region can be a kappa or lambda constant region.

To create a scFv gene, the VH- and VL-encoding DNA fragments are operatively linked to another fragment encoding a flexible linker, e.g., encoding the amino acid sequence (Gly$_4$-Ser)$_3$, such that the VH and VL sequences can be expressed as a contiguous single-chain protein, with the VL and VH regions joined by the flexible linker (see e.g., Bird et al. (1988) Science 242:423-426; Huston et al. (1988) Proc. Natl. Acad. Sci. USA 85:5879-5883; McCafferty et al., (1990) Nature 348:552-554).

Also provided herein are nucleic acid molecules encoding VH and VL sequences or full length heavy and light chains that are homologous to those of antibodies described herein, e.g., the 11F11-1, 11F11-2, 4C3-1, 4C3-2, 4C3-3, 4D4, 10D2-1, 10D2-2, 11A6, 24H2, 5F8-1, 5F8-2, 6E11 7A11, CD73.3 and/or CD73.4 monoclonal antibodies. Exemplary nucleic acid molecules encode VH and VL sequences that are at least 70% identical, for example, at least 75%, at least 80%, at least 85%, at least 90%, at least 95%, or at least 99% identical, to nucleic acid molecules encoding the VH and VL sequences or the full length heavy and light chains of the 11F11-1, 11F11-2, 4C3-1, 4C3-2, 4C3-3, 4D4, 10D2-1, 10D2-2, 11A6, 24H2, 5F8-1, 5F8-2, 6E11 7A11, CD73.3 and/or CD73.4 monoclonal antibodies, e.g., the sequences set forth in Table 35. For example, provided herein are anti-CD73 antibodies comprising a VH chain and a VL chain that are encoded by nucleotides sequences that are at least 80%, 85%, 90%, 95%, 96%, 97%, 98%, 99% or 100% identical to SEQ ID NO: 139 and SEQ ID NO: 140 or 141; SEQ ID NO: 237 and SEQ ID NO: 140 or 141; SEQ ID NO: 142 and SEQ ID NO: 143, 144 or 145; SEQ ID NO: 146 and SEQ ID NO: 147; SEQ ID NO: 148 and SEQ ID NO:149 or 150; SEQ ID NO: 151 and SEQ ID NO: 152; SEQ ID NO: 153 and SEQ ID NO: 154; SEQ ID NO: 155 and SEQ ID NO: 156 or 157 or 242; SEQ ID NO: 158 and SEQ ID NO: 159; SEQ ID NO: 160 and SEQ ID NO: 161. Also provided are anti-CD73 antibodies comprising a heavy chain and a light chain that are encoded by nucleotides sequences that are at least 80%, 85%, 90%, 95%, 96%, 97%, 98%, 99% or 100% identical to SEQ ID NOs: 134, 214, 215, 216, 217, 218, 219, 220, 221, 222, 223, 224, 225, 226, 227, 228, 229, 230, 231, 232, 233, 234, 243, 266 (heavy chain) and SEQ ID NO: 244 or 245 (light chain); SEQ ID NO: 211, 212, 213 or 246 and SEQ ID NO: 247, 248 or 249; SEQ ID NO: 235, 236 or 250 and 251; SEQ ID NO: 252 and SEQ ID NO: 253 or 254; SEQ ID NO: 255 and SEQ ID NO: 256; SEQ ID NO: 257 and SEQ ID NO: 258; SEQ ID NO: 259 and SEQ ID NO: 260 or 261; SEQ ID NO: 262 and SEQ ID NO: 263; SEQ ID NO: 264 and SEQ ID NO: 265. Also provided herein are nucleic acid molecules with silent mutations (i.e., base changes that do not alter the resulting amino acid sequence upon translation of nucleic acid molecule), e.g., for codon optimization.

XI. Antibody Generation

Various antibodies of the present invention, e.g. those that compete with or bind to the same epitope as the anti-human CD73 antibodies disclosed herein, can be produced using a variety of known techniques, such as the standard somatic cell hybridization technique described by Kohler and Milstein, Nature 256:495 (1975). Although somatic cell hybridization procedures are preferred, in principle, other techniques for producing monoclonal antibodies also can be employed, e.g., viral or oncogenic transformation of B lymphocytes, phage display technique using libraries of human antibody genes.

The preferred animal system for preparing hybridomas is the murine system. Hybridoma production in the mouse is a very well-established procedure. Immunization protocols and techniques for isolation of immunized splenocytes for fusion are known in the art. Fusion partners (e.g., murine myeloma cells) and fusion procedures are also known.

Chimeric or humanized antibodies described herein can be prepared based on the sequence of a murine monoclonal antibody prepared as described above. DNA encoding the heavy and light chain immunoglobulins can be obtained from the murine hybridoma of interest and engineered to contain non-murine (e.g., human) immunoglobulin sequences using standard molecular biology techniques. For example, to create a chimeric antibody, the murine variable regions can be linked to human constant regions using methods known in the art (see e.g., U.S. Pat. No. 4,816,567 to Cabilly et al.). To create a humanized antibody, the murine CDR regions can be inserted into a human framework using methods known in the art (see e.g., U.S. Pat. No. 5,225,539 to Winter, and U.S. Pat. Nos. 5,530,101; 5,585,089; 5,693, 762 and 6,180,370 to Queen et al.).

In one embodiment, the antibodies described herein are human monoclonal antibodies. Such human monoclonal antibodies directed against CD73 can be generated using transgenic or transchromosomic mice carrying parts of the human immune system rather than the mouse system. These transgenic and transchromosomic mice include mice referred to herein as HuMAb mice and KM mice, respectively, and are collectively referred to herein as "human Ig mice."

The HuMAb Mouse® (Medarex, Inc.) contains human immunoglobulin gene miniloci that encode unrearranged human heavy (μ and γ) and κ light chain immunoglobulin sequences, together with targeted mutations that inactivate the endogenous μ and κ chain loci (see e.g., Lonberg, et al. (1994) Nature 368(6474): 856-859). Accordingly, the mice exhibit reduced expression of mouse IgM or κ, and in response to immunization, the introduced human heavy and light chain transgenes undergo class switching and somatic mutation to generate high affinity human IgGκ monoclonal (Lonberg, N. et al. (1994), supra; reviewed in Lonberg, N. (1994) Handbook of Experimental Pharmacology 113:49-101; Lonberg, N. and Huszar, D. (1995) Intern. Rev. Immunol. 13: 65-93, and Harding, F. and Lonberg, N. (1995) Ann. N.Y. Acad. Sci. 764:536-546). The preparation and use of HuMab mice, and the genomic modifications carried by such mice, is further described in Taylor, L. et al. (1992) Nucleic Acids Research 20:6287-6295; Chen, J. et al. (1993) International Immunology 5: 647-656; Tuaillon et al. (1993) Proc. Natl. Acad. Sci. USA 90:3720-3724; Choi et al. (1993) Nature Genetics 4:117-123; Chen, J. et al. (1993) EMBO J. 12: 821-830; Tuaillon et al. (1994) J. Immunol. 152:2912-2920; Taylor, L. et al. (1994) International Immunology 6: 579-591; and Fishwild, D. et al. (1996) Nature Biotechnology 14: 845-851, the contents of all of which are hereby specifically incorporated by reference in their entirety. See further, U.S. Pat. Nos. 5,545,806; 5,569,825; 5,625,126; 5,633,425; 5,789,650; 5,877,397; 5,661,016; 5,814,318; 5,874,299; and 5,770,429; all to Lonberg and Kay; U.S. Pat. No. 5,545,807 to Surani et al.; PCT Publication Nos. WO 92/03918, WO 93/12227, WO 94/25585, WO 97/13852, WO 98/24884 and WO 99/45962, all to Lonberg and Kay; and PCT Publication No. WO 01/14424 to Korman et al.

In certain embodiments, antibodies described herein are raised using a mouse that carries human immunoglobulin sequences on transgenes and transchromosomes, such as a mouse that carries a human heavy chain transgene and a human light chain transchromosome. Such mice, referred to herein as "KM mice", are described in detail in PCT Publication WO 02/43478 to Ishida et al.

Still further, alternative transgenic animal systems expressing human immunoglobulin genes are available in the art and can be used to raise anti-CD73 antibodies described herein. For example, an alternative transgenic system referred to as the Xenomouse (Abgenix, Inc.) can be used; such mice are described in, for example, U.S. Pat. Nos. 5,939,598; 6,075,181; 6,114,598; 6, 150,584 and 6,162,963 to Kucherlapati et al.

Moreover, alternative transchromosomic animal systems expressing human immunoglobulin genes are available in the art and can be used to raise anti-CD73 antibodies described herein. For example, mice carrying both a human heavy chain transchromosome and a human light chain transchromosome, referred to as "TC mice" can be used; such mice are described in Tomizuka et al. (2000) Proc. Natl. Acad. Sci. USA 97:722-727. Furthermore, cows carrying human heavy and light chain transchromosomes have been described in the art (Kuroiwa et al. (2002) Nature Biotechnology 20:889-894) and can be used to raise anti-CD73 antibodies described herein.

Additional mouse systems described in the art for raising human antibodies, e.g., human anti-CD73 antibodies, include (i) the VelocImmune® mouse (Regeneron Pharmaceuticals, Inc.), in which the endogenous mouse heavy and light chain variable regions have been replaced, via homologous recombination, with human heavy and light chain variable regions, operatively linked to the endogenous mouse constant regions, such that chimeric antibodies (human V/mouse C) are raised in the mice, and then subsequently converted to fully human antibodies using standard recombinant DNA techniques; and (ii) the MeMo® mouse (Merus Biopharmaceuticals, Inc.), in which the mouse contains unrearranged human heavy chain variable regions but a single rearranged human common light chain variable region. Such mice, and use thereof to raise antibodies, are described in, for example, WO 2009/15777, US 2010/0069614, WO 2011/072204, WO 2011/097603, WO 2011/163311, WO 2011/163314, WO 2012/148873, US 2012/0070861 and US 2012/0073004.

Human monoclonal antibodies described herein can also be prepared using phage display methods for screening libraries of human immunoglobulin genes. Such phage display methods for isolating human antibodies are established in the art. See for example: U.S. Pat. Nos. 5,223,409; 5,403,484; and 5,571,698 to Ladner et al.; U.S. Pat. Nos. 5,427,908 and 5,580,717 to Dower et al.; U.S. Pat. Nos. 5,969,108 and 6,172,197 to McCafferty et al.; and U.S. Pat. Nos. 5,885,793; 6,521,404; 6,544,731; 6,555,313; 6,582,915 and 6,593,081 to Griffiths et al.

Human monoclonal antibodies described herein can also be prepared using SCID mice into which human immune cells have been reconstituted such that a human antibody response can be generated upon immunization. Such mice are described in, for example, U.S. Pat. Nos. 5,476,996 and 5,698,767 to Wilson et al.

Immunizations

To generate fully human antibodies to CD73, transgenic or transchromosomal mice containing human immunoglobulin genes (e.g., HCo12, HCo7 or KM mice) can be immunized with a purified or enriched preparation of the CD73 antigen and/or cells expressing CD73, as described for other antigens, for example, by Lonberg et al. (1994) Nature 368(6474): 856-859; Fishwild et al. (1996) Nature Biotechnology 14: 845-851 and WO 98/24884. Alternatively, mice can be immunized with DNA encoding human CD73. Preferably, the mice will be 6-16 weeks of age upon the first infusion. For example, a purified or enriched preparation (5-50 µg) of the recombinant CD73 antigen can be used to immunize the HuMAb mice intraperitoneally. In the event that immunizations using a purified or enriched preparation of the CD73antigen do not result in antibodies, mice can also be immunized with cells expressing CD73, e.g., a cell line, to promote immune responses. Exemplary cell lines include CD73-overexpressing stable CHO and Raji cell lines.

Cumulative experience with various antigens has shown that the HuMAb transgenic mice respond best when initially immunized intraperitoneally (IP) or subcutaneously (SC) with antigen in Ribi's adjuvant, followed by every other week IP/SC immunizations (up to a total of 10) with antigen in Ribi's adjuvant. The immune response can be monitored over the course of the immunization protocol with plasma samples being obtained by retroorbital bleeds. The plasma can be screened by ELISA and FACS (as described below), and mice with sufficient titers of anti-CD73 human immunoglobulin can be used for fusions. Mice can be boosted intravenously with antigen 3 days before sacrifice and removal of the spleen and lymph nodes. It is expected that 2-3 fusions for each immunization may need to be performed. Between 6 and 24 mice are typically immunized for each antigen. Usually, HCo7, HCo12, and KM strains are used. In addition, both HCo7 and HCo12 transgene can be bred together into a single mouse having two different human heavy chain transgenes (HCo7/HCo12).

Generation of Hybridomas Producing Monoclonal Antibodies to CD73

To generate hybridomas producing human monoclonal antibodies described herein, splenocytes and/or lymph node cells from immunized mice can be isolated and fused to an appropriate immortalized cell line, such as a mouse myeloma cell line. The resulting hybridomas can be screened for the production of antigen-specific antibodies. For example, single cell suspensions of splenic lymphocytes from immunized mice can be fused to Sp2/0 nonsecreting mouse myeloma cells (ATCC, CRL 1581) with 50% PEG. Cells are plated at approximately $2 \times 10^5$ in flat bottom microtiter plate, followed by a two week incubation in selective medium containing 10% fetal Clone Serum, 18% "653" conditioned media, 5% origen (IGEN), 4 mM L-glutamine, 1 mM sodium pyruvate, 5 mM HEPES, 0.055 mM 2-mercaptoethanol, 50 units/ml penicillin, 50 mg/ml streptomycin, 50 mg/ml gentamycin and 1X HAT (Sigma). After approximately two weeks, cells can be cultured in medium in which the HAT is replaced with HT. Individual wells can then be screened by ELISA for human monoclonal IgM and IgG antibodies. Once extensive hybridoma growth occurs, medium can be observed usually after 10-14 days. The antibody secreting hybridomas can be replated, screened again, and if still positive for human IgG, the monoclonal antibodies can be subcloned at least twice by limiting dilution. The stable subclones can then be cultured in vitro to generate small amounts of antibody in tissue culture medium for characterization.

To purify human monoclonal antibodies, selected hybridomas can be grown in two-liter spinner-flasks for monoclonal antibody purification. Supernatants can be filtered and concentrated before affinity chromatography with protein A-sepharose (Pharmacia, Piscataway, N.J.). Eluted IgG can be checked by gel electrophoresis and high performance liquid chromatography to ensure purity. The buffer solution can be exchanged into PBS, and the concentration can be determined by OD280 using 1.43 extinction coefficient. The monoclonal antibodies can be aliquoted and stored at −80° C.

XII. Antibody Manufacture

Generation of Transfectomas Producing Monoclonal Antibodies to CD73

Antibodies of the present invention, including both specific antibodies for which sequences are provided and other, related anti-CD73 antibodies, can be produced in a host cell transfectoma using, for example, a combination of recombinant DNA techniques and gene transfection methods as is well known in the art (Morrison, S. (1985) Science 229: 1202).

For example, to express antibodies, or antibody fragments thereof, DNAs encoding partial or full-length light and heavy chains, can be obtained by standard molecular biology techniques (e.g., PCR amplification or cDNA cloning using a hybridoma that expresses the antibody of interest) and the DNAs can be inserted into expression vectors such that the genes are operatively linked to transcriptional and translational control sequences. In this context, the term "operatively linked" is intended to mean that an antibody gene is ligated into a vector such that transcriptional and translational control sequences within the vector serve their intended function of regulating the transcription and translation of the antibody gene. The expression vector and expression control sequences are chosen to be compatible with the expression host cell used. The antibody light chain gene and the antibody heavy chain gene can be inserted into separate vector or both genes are inserted into the same expression vector. The antibody genes are inserted into the expression vector(s) by standard methods (e.g., ligation of complementary restriction sites on the antibody gene fragment and vector, or blunt end ligation if no restriction sites are present). The light and heavy chain variable regions of the antibodies described herein can be used to create full-length antibody genes of any antibody isotype by inserting them into expression vectors already encoding heavy chain constant and light chain constant regions of the desired isotype such that the $V_H$ segment is operatively linked to the $C_H$ segment(s) within the vector and the $V_L$ segment is operatively linked to the $C_L$ segment within the vector. Additionally or alternatively, the recombinant expression vector can encode a signal peptide that facilitates secretion of the antibody chain from a host cell. The antibody chain gene can be cloned into the vector such that the signal peptide is linked in-frame to the amino terminus of the antibody chain gene. The signal peptide can be an immunoglobulin signal peptide or a heterologous signal peptide (i.e., a signal peptide from a non-immunoglobulin protein).

In addition to the antibody chain genes, recombinant expression vectors may carry regulatory sequences that control the expression of the antibody chain genes in a host cell. The term "regulatory sequence" is intended to include promoters, enhancers and other expression control elements (e.g., polyadenylation signals) that control the transcription or translation of the antibody chain genes. Such regulatory sequences are described, for example, in Goeddel (Gene Expression Technology. Methods in Enzymology 185, Academic Press, San Diego, Calif. (1990)). It will be appreciated by those skilled in the art that the design of the expression vector, including the selection of regulatory sequences, may depend on such factors as the choice of the host cell to be transformed, the level of expression of protein desired, etc. Preferred regulatory sequences for mammalian host cell expression include viral elements that direct high levels of protein expression in mammalian cells, such as promoters and/or enhancers derived from cytomegalovirus (CMV), Simian Virus 40 (SV40), adenovirus, (e.g., the adenovirus major late promoter (AdMLP) and polyoma. Alternatively, nonviral regulatory sequences may be used, such as the ubiquitin promoter or β-globin promoter. Still further, regulatory elements composed of sequences from different sources, such as the SRα promoter system, which contains sequences from the SV40 early promoter and the long terminal repeat of human T cell leukemia virus type 1 (Takebe, Y. et al. (1988) *Mol. Cell. Biol.* 8:466-472).

In addition to the antibody chain genes and regulatory sequences, recombinant expression vectors may carry additional sequences, such as sequences that regulate replication of the vector in host cells (e.g., origins of replication) and selectable marker genes. The selectable marker gene facilitates selection of host cells into which the vector has been introduced (see, e.g., U.S. Pat. Nos. 4,399,216, 4,634,665 and 5,179,017, all by Axel et al.). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr-host cells with methotrexate selection/amplification) and the neo gene (for G418 selection).

For expression of the light and heavy chains, the expression vector(s) encoding the heavy and light chains is transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is theoretically possible to express the antibodies described herein in either prokaryotic or eukaryotic host cells, expression of antibodies in eukaryotic cells, and most preferably mammalian host cells, is the most preferred because such eukaryotic cells, and in particular mammalian cells, are more likely than prokaryotic cells to assemble and secrete a properly folded and immunologically active antibody. Prokaryotic expression of antibody genes has been reported to be ineffective for production of high yields of active antibody (Boss, M. A. and Wood, C. R. (1985) *Immunology Today* 6:12-13). Antibodies of the present invention can also be produced in glycoengineered strains of the yeast *Pichia pastoris*. Li et al. (2006) *Nat. Biotechnol.* 24:210.

Preferred mammalian host cells for expressing the recombinant antibodies described herein include Chinese Hamster Ovary (CHO cells) (including dhfr-CHO cells, described in Urlaub and Chasin, (1980) *Proc. Natl. Acad. Sci. USA* 77:4216-4220, used with a DHFR selectable marker, e.g., as described in R. J. Kaufman and P. A. Sharp (1982) *Mol. Biol.* 159:601-621), NSO myeloma cells, COS cells and SP2 cells. In particular, for use with NSO myeloma cells, another preferred expression system is the GS gene expression system disclosed in WO 87/04462, WO 89/01036 and EP 338,841. When recombinant expression vectors encoding antibody genes are introduced into mammalian host cells, the antibodies are produced by culturing the host cells for a period of time sufficient to allow for expression of the antibody in the host cells or, more preferably, secretion of the antibody into the culture medium in which the host cells are grown. Antibodies can be recovered from the culture medium using standard protein purification methods.

The N- and C-termini of antibody polypeptide chains of the present invention may differ from the expected sequence due to commonly observed post-translational modifications. For example, C-terminal lysine residues are often missing from antibody heavy chains. Dick et al. (2008) *Biotechnol. Bioeng.* 100:1132. N-terminal glutamine residues, and to a lesser extent glutamate residues, are frequently converted to pyroglutamate residues on both light and heavy chains of therapeutic antibodies. Dick et al. (2007) *Biotechnol. Bioeng.* 97:544; Liu et al. (2011) *JBC* 28611211; Liu et al. (2011) *J. Biol. Chem.* 286:11211.

XIII. Assays

Antibodies described herein can be tested for binding to CD73 by, for example, standard ELISA. Briefly, microtiter plates are coated with purified CD73 at 1-2 µg/ml in PBS, and then blocked with 5% bovine serum albumin in PBS. Dilutions of antibody (e.g., dilutions of plasma from CD73-immunized mice) are added to each well and incubated for 1-2 hours at 37° C. The plates are washed with PBS/Tween and then incubated with secondary reagent (e.g., for human antibodies, a goat-anti-human IgG Fc-specific polyclonal reagent) conjugated to horseradish peroxidase (HRP) for 1 hour at 37° C. After washing, the plates are developed with ABTS substrate (Moss Inc, product: ABTS-1000) and analyzed by a spectrophotometer at OD 415-495. Sera from immunized mice are then further screened by flow cytometry for binding to a cell line expressing human CD73, but not to a control cell line that does not express CD73. Briefly, the binding of anti-CD73 antibodies is assessed by incubating CD73 expressing CHO cells with the anti-CD73 antibody at 1:20 dilution. The cells are washed and binding is detected with a PE-labeled anti-human IgG Ab. Flow cytometric analyses are performed using a FACScan flow cytometry (Becton Dickinson, San Jose, Calif.). Preferably, mice which develop the highest titers will be used for fusions.

An ELISA assay as described above can be used to screen for antibodies and, thus, hybridomas that produce antibodies that show positive reactivity with the CD73 immunogen. Hybridomas that produce antibodies that bind, preferably with high affinity, to CD73 can then be subcloned and further characterized. One clone from each hybridoma, which retains the reactivity of the parent cells (by ELISA), can then be chosen for making a cell bank, and for antibody purification.

To purify anti-CD73 antibodies, selected hybridomas can be grown in two-liter spinner-flasks for monoclonal antibody purification. Supernatants can be filtered and concentrated before affinity chromatography with protein A-sepharose (Pharmacia, Piscataway, N.J.). Eluted IgG can be checked by gel electrophoresis and high performance liquid chromatography to ensure purity. The buffer solution can be exchanged into PBS, and the concentration can be determined by $OD_{280}$ using 1.43 extinction coefficient. The monoclonal antibodies can be aliquoted and stored at −80° C.

To determine if the selected anti-CD73 monoclonal antibodies bind to unique epitopes, each antibody can be biotinylated using commercially available reagents (Pierce, Rockford, Ill.). Biotinylated mAb binding can be detected with a streptavidin labeled probe. Competition studies using unlabeled monoclonal antibodies and biotinylated monoclonal antibodies can be performed using CD73 coated-ELISA plates as described above.

To determine the isotype of purified antibodies, isotype ELISAs can be performed using reagents specific for antibodies of a particular isotype. For example, to determine the isotype of a human monoclonal antibody, wells of microtiter plates can be coated with 1 µg/ml of anti-human immunoglobulin overnight at 4° C. After blocking with 1% BSA, the plates are reacted with 1 µg/ml or less of test monoclonal antibodies or purified isotype controls, at ambient temperature for one to two hours. The wells can then be reacted with either human IgG1 or human IgM-specific alkaline phosphatase-conjugated probes. Plates are developed and analyzed as described above.

To test the binding of monoclonal antibodies to live cells expressing CD73, flow cytometry can be used, as described in the Examples. Briefly, cell lines expressing membrane-bound CD73 (grown under standard growth conditions) are mixed with various concentrations of monoclonal antibodies in PBS containing 0.1% BSA at 4° C. for 1 hour. After washing, the cells are reacted with Fluorescein-labeled anti-IgG antibody under the same conditions as the primary antibody staining. The samples can be analyzed by FACScan instrument using light and side scatter properties to gate on single cells and binding of the labeled antibodies is determined. An alternative assay using fluorescence microscopy may be used (in addition to or instead of) the flow cytometry assay. Cells can be stained exactly as described above and examined by fluorescence microscopy. This method allows visualization of individual cells, but may have diminished sensitivity depending on the density of the antigen.

Anti-CD73 antibodies can be further tested for reactivity with the CD73 antigen by Western blotting. Briefly, cell extracts from cells expressing CD73 can be prepared and subjected to sodium dodecyl sulfate polyacrylamide gel electrophoresis. After electrophoresis, the separated antigens will be transferred to nitrocellulose membranes, blocked with 20% mouse serum, and probed with the monoclonal antibodies to be tested. IgG binding can be detected using anti-IgG alkaline phosphatase and developed with BCIP/NBT substrate tablets (Sigma Chem. Co., St. Louis, Mo.).

Methods for analyzing binding affinity, cross-reactivity, and binding kinetics of various anti-CD73 antibodies include standard assays known in the art, for example, BIACORE® surface plasmon resonance (SPR) analysis using a BIACORE® 2000 SPR instrument (Biacore AB, Uppsala, Sweden).

XIV. Immunoconjugates and Antibody Derivatives

Antibodies described herein can be used for diagnostic purposes, including sample testing and in vivo imaging, and for this purpose the antibody (or binding fragment thereof) can be conjugated to an appropriate detectable agent, to form an immunoconjugate. For diagnostic purposes, appropriate agents are detectable labels that include radioisotopes, for whole body imaging, and radioisotopes, enzymes, fluorescent labels and other suitable antibody tags for sample testing.

The detectable labels can be any of the various types used currently in the field of in vitro diagnostics, including particulate labels including metal sols such as colloidal gold, isotopes such as $I^{125}$ or $Tc^{99}$ presented for instance with a peptidic chelating agent of the $N_2S_2$, $N_3S$ or $N_4$ type, chromophores including fluorescent markers, biotin, luminescent markers, phosphorescent markers and the like, as well as enzyme labels that convert a given substrate to a detectable marker, and polynucleotide tags that are revealed following amplification such as by polymerase chain reaction. A biotinylated antibody would then be detectable by avidin or streptavidin binding. Suitable enzyme labels include horseradish peroxidase, alkaline phosphatase and the like. For instance, the label can be the enzyme alkaline phosphatase, detected by measuring the presence or formation of chemiluminescence following conversion of 1,2 dioxetane substrates such as adamantyl methoxy phosphoryloxy phenyl dioxetane (AMPPD), disodium 3-(4-(methoxyspiro{1,2-dioxetane-3,2'-(5'-chloro)tricyclo{3.3.1.1 3,7}decan}-4-yl) phenyl phosphate (CSPD), as well as CDP and CDP-Star® or other luminescent substrates well-known to those in the art, for example the chelates of suitable lanthanides such as Terbium(III) and Europium(III). The detection means is determined by the chosen label. Appearance of the label or its reaction products can be achieved using the naked eye, in the case where the label is particulate and accumulates at appropriate levels, or using instruments such as a spectrophotometer, a luminometer, a fluorimeter, and the like, all in accordance with standard practice.

Preferably, conjugation methods result in linkages which are substantially (or nearly) non-immunogenic, e.g., peptide- (i.e. amide-), sulfide-, (sterically hindered), disulfide-, hydrazone-, and ether linkages. These linkages are nearly non-immunogenic and show reasonable stability within serum (see e.g. Senter, P. D., Curr. Opin. Chem. Biol. 13 (2009) 235-244; WO 2009/059278; WO 95/17886).

Depending on the biochemical nature of the moiety and the antibody, different conjugation strategies can be employed. In case the moiety is naturally occurring or recombinant polypeptide of between 50 to 500 amino acids, there are standard procedures in text books describing the chemistry for synthesis of protein conjugates, which can be easily followed by the skilled artisan (see e.g. Hackenberger, C. P. R., and Schwarzer, D., Angew. Chem. Int. Ed. Engl. 47 (2008) 10030-10074). In one embodiment the reaction of a maleinimido moiety with a cysteine residue within the antibody or the moiety is used. This is an especially suitable coupling chemistry in case e.g. a Fab or Fab'-fragment of an antibody is used. Alternatively in one embodiment coupling to the C-terminal end of the antibody or moiety is performed. C-terminal modification of a protein, e.g. of a Fab-fragment can be performed as described (Sunbul, M. and Yin, J., Org. Biomol. Chem. 7 (2009) 3361-3371).

In general site specific reaction and covalent coupling is based on transforming a natural amino acid into an amino acid with a reactivity which is orthogonal to the reactivity of the other functional groups present. For example, a specific cysteine within a rare sequence context can be enzymatically converted in an aldehyde (see Frese, M. A., and Dierks, T., ChemBioChem. 10 (2009) 425-427). It is also possible to obtain a desired amino acid modification by utilizing the specific enzymatic reactivity of certain enzymes with a natural amino acid in a given sequence context (see, e.g., Taki, M. et al., Prot. Eng. Des. Sel. 17 (2004) 119-126; Gautier, A. et al. Chem. Biol. 15 (2008) 128-136. Protease-catalyzed formation of C—N bonds is described at Bordusa, F., Highlights in Bioorganic Chemistry (2004) 389-403.

Site specific reaction and covalent coupling can also be achieved by the selective reaction of terminal amino acids with appropriate modifying reagents. The reactivity of an N-terminal cysteine with benzonitrils (see Ren, H. et al., Angew. Chem. Int. Ed. Engl. 48 (2009) 9658-9662) can be used to achieve a site-specific covalent coupling. Native chemical ligation can also rely on C-terminal cysteine residues (Taylor, E. Vogel; Imperiali, B, Nucleic Acids and Molecular Biology (2009), 22 (Protein Engineering), 65-96). EP 1 074 563 describes a conjugation method which is based on the faster reaction of a cysteine within a stretch of negatively charged amino acids than a cysteine located in a stretch of positively charged amino acids.

The moiety may also be a synthetic peptide or peptide mimic. In case a polypeptide is chemically synthesized, amino acids with orthogonal chemical reactivity can be incorporated during such synthesis (see e.g. de Graaf, A. J. et al., Bioconjug. Chem. 20 (2009) 1281-1295). Since a great variety of orthogonal functional groups is at stake and can be introduced into a synthetic peptide, conjugation of such peptide to a linker is standard chemistry.

In order to obtain a mono-labeled polypeptide the conjugate with 1:1 stoichiometry may be separated by chromatography from other conjugation side-products. This procedure can be facilitated by using a dye labeled binding pair member and a charged linker. By using this kind of labeled and highly negatively charged binding pair member, mono conjugated polypeptides are easily separated from non-labeled polypeptides and polypeptides which carry more than one linker, since the difference in charge and molecular weight can be used for separation. The fluorescent dye can be useful for purifying the complex from un-bound components, like a labeled monovalent binder.

In one embodiment the moiety attached to an anti-CD73 antibody is selected from the group consisting of a binding moiety, a labeling moiety, and a biologically active moiety.

Antibodies described herein may also be conjugated to a therapeutic agent to form an immunoconjugate such as an antibody-drug conjugate (ADC). Suitable therapeutic agents include antimetabolites, alkylating agents, DNA minor groove binders, DNA intercalators, DNA crosslinkers, histone deacetylase inhibitors, nuclear export inhibitors, proteasome inhibitors, topoisomerase I or II inhibitors, heat shock protein inhibitors, tyrosine kinase inhibitors, antibiotics, and anti-mitotic agents. In the ADC, the antibody and therapeutic agent preferably are conjugated via a linker cleavable such as a peptidyl, disulfide, or hydrazone linker. More preferably, the linker is a peptidyl linker such as Val-Cit, Ala-Val, Val-Ala-Val, Lys-Lys, Pro-Val-Gly-Val-Val (SEQ ID NO: 219), Ala-Asn-Val, Val-Leu-Lys, Ala-Ala-Asn, Cit-Cit, Val-Lys, Lys, Cit, Ser, or Glu. The ADCs can be prepared as described in U.S. Pat. Nos. 7,087,600; 6,989,452; and 7,129,261; PCT Publications WO 02/096910; WO 07/038658; WO 07/051081; WO 07/059404; WO 08/083312; and WO 08/103693; U.S. Patent Publications 20060024317; 20060004081; and 20060247295; the disclosures of which are incorporated herein by reference. Other uses for anti-CD73 antibodies, e.g., as monotherapy, are provided elsewhere herein, e.g., in the section pertaining to combination treatments.

More specifically, in an ADC, the antibody is conjugated to a drug, with the antibody functioning as a targeting agent for directing the ADC to a target cell expressing its antigen, such as a cancer cell. Preferably, the antigen is a tumor associated antigen, i.e., one that is uniquely expressed or overexpressed by the cancer cell. Once there, the drug is released, either inside the target cell or in its vicinity, to act as a therapeutic agent. For a review on the mechanism of action and use of ADCs in cancer therapy, see Schrama et al., *Nature Rev. Drug Disc.* 2006, 5, 147.

For cancer treatment, the drug preferably is a cytotoxic drug that causes death of the targeted cancer cell. Cytotoxic drugs that can be used in ADCs include the following types of compounds and their analogs and derivatives:

(a) enediynes such as calicheamicin (see, e.g., Lee et al., *J. Am. Chem. Soc.* 1987, 109, 3464 and 3466) and uncialamycin (see, e.g., Davies et al., WO 2007/038868 A2 (2007) and Chowdari et al., U.S. Pat. No. 8,709,431 B2 (2012));
(b) tubulysins (see, e.g., Domling et al., U.S. Pat. No. 7,778,814 B2 (2010); Cheng et al., U.S. Pat. No. 8,394,922 B2 (2013); and Cong et al., US 2014/0227295 A1;
(c) CC-1065 and duocarmycin (see, e.g., Boger, U.S. Pat. No. 65,458,530 B1 (2003); Sufi et al., U.S. Pat. No. 8,461,117 B2 (2013); and Zhang et al., US 2012/0301490 A1 (2012));
(d) epothilones (see, e.g., Vite et al., US 2007/0275904 A1 (2007) and US RE42930 E (2011));
(e) auristatins (see, e.g., Senter et al., U.S. Pat. No. 6,844,869 B2 (2005) and Doronina et al., U.S. Pat. No. 7,498,298 B2 (2009));
(f) pyrrolobezodiazepine (PBD) dimers (see, e.g., Howard et al., US 2013/0059800 A1(2013); US 2013/0028919 A1 (2013); and WO 2013/041606 A1 (2013)); and
(g) maytansinoids such as DM1 and DM4 (see, e.g., Chari et al., U.S. Pat. No. 5,208,020 (1993) and Amphlett et al., U.S. Pat. No. 7,374,762 B2 (2008)).

XV. Bispecific Molecules

Antibodies described herein may be used for forming bispecific molecules. An anti-CD73 antibody, or antigen-binding portions thereof, can be derivatized or linked to another functional molecule, e.g., another peptide or protein (e.g., another antibody or ligand for a receptor) to generate a bispecific molecule that binds to at least two different binding sites or target molecules. The antibody described herein may in fact be derivatized or linked to more than one other functional molecule to generate multispecific molecules that bind to more than two different binding sites and/or target molecules; such multispecific molecules are also intended to be encompassed by the term "bispecific molecule" as used herein. To create a bispecific molecule described herein, an antibody described herein can be functionally linked (e.g., by chemical coupling, genetic fusion, noncovalent association or otherwise) to one or more other binding molecules, such as another antibody, antibody fragment, peptide or binding mimetic, such that a bispecific molecule results.

Accordingly, provided herein are bispecific molecules comprising at least one first binding specificity for CD73 and a second binding specificity for a second target epitope. In an embodiment described herein in which the bispecific molecule is multispecific, the molecule can further include a third binding specificity.

In one embodiment, the bispecific molecules described herein comprise as a binding specificity at least one antibody, or an antibody fragment thereof, including, e.g., an Fab, Fab', F(ab')$_2$, Fv, or a single chain Fv. The antibody may also be a light chain or heavy chain dimer, or any minimal fragment thereof such as a Fv or a single chain construct as described in Ladner et al. U.S. Pat. No. 4,946,778, the contents of which is expressly incorporated by reference.

Binding of the bispecific molecules to their specific targets can be confirmed using art-recognized methods, such as enzyme-linked immunosorbent assay (ELISA), radioimmunoassay (RIA), FACS analysis, bioassay (e.g., growth inhibition), or Western Blot assay. Each of these assays generally detects the presence of protein-antibody complexes of particular interest by employing a labeled reagent (e.g., an antibody) specific for the complex of interest.

XVI. Compositions

Further provided are compositions, e.g., a pharmaceutical compositions, containing one or a combination of anti-CD73 antibodies, or antigen-binding portion(s) thereof, described herein, formulated together with a pharmaceutically acceptable carrier. Such compositions may include one or a combination of (e.g., two or more different) antibodies, or immunoconjugates or bispecific molecules described herein. For example, a pharmaceutical composition described herein can comprise a combination of antibodies (or immunoconjugates or bispecifics) that bind to different epitopes on the target antigen or that have complementary activities.

In certain embodiments, a composition comprises an anti-CD73 antibody at a concentration of at least 1 mg/ml, 5 mg/ml, 10 mg/ml, 50 mg/ml, 100 mg/ml, 150 mg/ml, 200 mg/ml, 1-300 mg/ml, or 100-300 mg/ml.

Pharmaceutical compositions described herein also can be administered in combination therapy, i.e., combined with other agents. For example, the combination therapy can include an anti-CD73 antibody described herein combined with at least one other anti-cancer and/or T-cell stimulating (e.g., activating) agent. Examples of therapeutic agents that can be used in combination therapy are described in greater detail below in the section on uses of the antibodies described herein.

In some embodiments, therapeutic compositions disclosed herein can include other compounds, drugs, and/or agents used for the treatment of cancer. Such compounds, drugs, and/or agents can include, for example, chemotherapy drugs, small molecule drugs or antibodies that stimulate the immune response to a given cancer. In some instances, therapeutic compositions can include, for example, one or more of the agents listed in the section on combination therapies.

As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the active compound, i.e., antibody, immunoconjugate, or bispecific molecule, may be coated in a material to protect the compound from the action of acids and other natural conditions that may inactivate the compound.

The pharmaceutical compounds described herein may include one or more pharmaceutically acceptable salts. A "pharmaceutically acceptable salt" refers to a salt that retains the desired biological activity of the parent compound and does not impart any undesired toxicological effects (see e.g., Berge, S. M., et al. (1977) *J. Pharm. Sci.* 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

A pharmaceutical composition described herein also may include a pharmaceutically acceptable anti-oxidant. Examples of pharmaceutically acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Examples of suitable aqueous and nonaqueous carriers that may be employed in the pharmaceutical compositions described herein include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of presence of microorganisms may be ensured both by sterilization procedures, supra, and by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any conventional media or agent is incompatible with the active compound, use thereof in the pharmaceutical compositions described herein is contemplated. Supplementary active compounds can also be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, or sodium chloride in the composition. Prolonged absorption of the injectable compositions can be brought about by including in the composition an agent that delays absorption, for example, monostearate salts and gelatin.

Sterile injectable solutions can be prepared by incorporating the active compound in the required amount in an appropriate solvent with one or a combination of ingredients enumerated above, as required, followed by sterilization microfiltration. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying (lyophilization) that yield a powder of the active ingredient plus any additional desired ingredient from a previously sterile-filtered solution thereof.

The amount of active ingredient which can be combined with a carrier material to produce a single dosage form will vary depending upon the subject being treated, and the particular mode of administration. The amount of active ingredient which can be combined with a carrier material to produce a single dosage form will generally be that amount of the composition which produces a therapeutic effect. Generally, out of one hundred percent, this amount will range from about 0.01 percent to about ninety-nine percent of active ingredient, preferably from about 0.1 percent to about 70 percent, most preferably from about 1 percent to about 30 percent of active ingredient in combination with a pharmaceutically acceptable carrier.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms described herein are dictated by and directly dependent on (a) the unique characteristics of the active compound and the particular therapeutic effect to be achieved, and (b) the limitations inherent in the art of compounding such an active compound for the treatment of sensitivity in individuals.

For administration of the antibody, the dosage ranges from about 0.0001 to 100 mg/kg, and more usually 0.01 to 5 mg/kg, of the host body weight. For example dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months.

In some methods, two or more monoclonal antibodies with different binding specificities are administered simultaneously, in which case the dosage of each antibody administered falls within the ranges indicated. Antibody is usually administered on multiple occasions. Intervals between single dosages can be, for example, weekly, monthly, every three months or yearly. Intervals can also be irregular as indicated by measuring blood levels of antibody to the target antigen in the patient. In some methods, dosage is adjusted to achieve a plasma antibody concentration of about 1-1000 µg/ml and in some methods about 25-300 µg/ml.

An antibody can be administered as a sustained release formulation, in which case less frequent administration is required. Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably until the patient shows partial or complete amelioration of symptoms of disease. Thereafter, the patient can be administered a prophylactic regime.

Actual dosage levels of the active ingredients in the pharmaceutical compositions described herein may be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions described herein employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

A "therapeutically effective dosage" of an anti-CD73 antibody described herein preferably results in a decrease in severity of disease symptoms, an increase in frequency and duration of disease symptom-free periods, or a prevention of impairment or disability due to the disease affliction. In the context of cancer, a therapeutically effective dose preferably prevents further deterioration of physical symptoms associated with cancer. Symptoms of cancer are well-known in the art and include, for example, unusual mole features, a change in the appearance of a mole, including asymmetry, border, color and/or diameter, a newly pigmented skin area, an abnormal mole, darkened area under nail, breast lumps, nipple changes, breast cysts, breast pain, death, weight loss, weakness, excessive fatigue, difficulty eating, loss of appetite, chronic cough, worsening breathlessness, coughing up blood, blood in the urine, blood in stool, nausea, vomiting, liver metastases, lung metastases, bone metastases, abdominal fullness, bloating, fluid in peritoneal cavity, vaginal bleeding, constipation, abdominal distension, perforation of colon, acute peritonitis (infection, fever, pain), pain, vomiting blood, heavy sweating, fever, high blood pressure, anemia, diarrhea, jaundice, dizziness, chills, muscle spasms, colon metastases, lung metastases, bladder metastases, liver metastases, bone metastases, kidney metastases, and pancreatic metastases, difficulty swallowing, and the like.

A therapeutically effective dose may prevent or delay onset of cancer, such as may be desired when early or preliminary signs of the disease are present. Laboratory tests utilized in the diagnosis of cancer include chemistries (including the measurement of CD73 levels), hematology, serology and radiology. Accordingly, any clinical or biochemical assay that monitors any of the foregoing may be used to determine whether a particular treatment is a therapeutically effective dose for treating cancer. One of ordinary skill in the art would be able to determine such amounts based on such factors as the subject's size, the severity of the subject's symptoms, and the particular composition or route of administration selected.

A composition described herein can be administered via one or more routes of administration using one or more of a variety of methods known in the art. As will be appreciated by the skilled artisan, the route and/or mode of administration will vary depending upon the desired results. Preferred routes of administration for antibodies described herein include intravenous, intramuscular, intradermal, intraperitoneal, subcutaneous, spinal or other parenteral routes of administration, for example by injection or infusion. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Alternatively, an antibody described herein can be administered via a non-parenteral route, such as a topical, epidermal or mucosal route of administration, for example, intranasally, orally, vaginally, rectally, sublingually or topically.

The active compounds can be prepared with carriers that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978.

Therapeutic compositions can be administered with medical devices known in the art. For example, in a preferred embodiment, a therapeutic composition described herein can be administered with a needleless hypodermic injection device, such as the devices disclosed in U.S. Pat. Nos. 5,399,163; 5,383,851; 5,312,335; 5,064,413; 4,941,880; 4,790,824; or 4,596,556. Examples of well-known implants and modules for use with anti-CD73 antibodies described herein include: U.S. Pat. No. 4,487,603, which discloses an implantable micro-infusion pump for dispensing medication at a controlled rate; U.S. Pat. No. 4,486,194, which discloses a therapeutic device for administering medicants through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system. These patents are incorporated herein by reference. Many other such implants, delivery systems, and modules are known to those skilled in the art.

In certain embodiments, the anti-CD73 antibodies described herein can be formulated to ensure proper distribution in vivo. For example, the blood-brain barrier (BBB) excludes many highly hydrophilic compounds. To ensure that the therapeutic compounds described herein cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties which are selectively transported into specific cells or organs, thus enhance targeted drug delivery (see, e.g., V. V. Ranade (1989) *J. Clin. Pharmacol.* 29:685). Exemplary targeting moieties include folate or biotin (see, e.g., U.S. Pat. No. 5,416,016 to Low et al.); mannosides (Umezawa et al., (1988) *Biochem. Biophys. Res. Commun.* 153:1038); antibodies (P. G. Bloeman et al. (1995) *FEBS Lett.* 357:140; M. Owais et al. (1995) *Antimicrob. Agents Chemother.* 39:180); surfactant protein A receptor (Briscoe et al. (1995) *Am. J. Physiol.* 1233:134); p 120 (Schreier et al. (1994) *J. Biol. Chem.* 269:9090); see also K. Keinanen; M. L. Laukkanen (1994) *FEBS Lett.* 346:123; J. J. Killion; I. J. Fidler (1994) *Immunomethods* 4:273.

XVII. Uses and Methods

The antibodies, antibody compositions and methods described herein have numerous in vitro and in vivo applications, e.g., inhibiting tumor growth, inhibiting tumor metastasis, enhancing of immune response by, e.g., reducing adenosine signaling, or detection of CD73. In a preferred embodiment, the antibodies described herein are human antibodies. For example, anti-CD73 antibodies described herein can be administered to cells in culture, in vitro or ex vivo, or to human subjects, e.g., in vivo, to inhibit tumor cell proliferation. Accordingly, provided herein are methods of modifying tumor growth in a subject comprising administering to the subject an antibody, or antigen-binding portion thereof, described herein such that the tumor growth in the subject is reduced.

In a particular embodiment, the methods are particularly suitable for treatment of cancer in vivo. To achieve antigen-specific inhibition of tumor growth, anti-CD73 antibodies described herein can be administered together with an antigen of interest or the antigen may already be present in the subject to be treated (e.g., a tumor-bearing subject). When antibodies to CD73 are administered together with another agent, the two can be administered separately or simultaneously.

Also encompassed are methods for detecting the presence of human CD73 antigen in a sample, or measuring the amount of human CD73 antigen, comprising contacting the sample, and a control sample, with a human monoclonal antibody, or an antigen binding portion thereof, which specifically binds to human CD73, under conditions that allow for formation of a complex between the antibody or portion thereof and human CD73. The formation of a complex is then detected, wherein a difference complex formation between the sample compared to the control sample is indicative the presence of human CD73 antigen in the sample. Moreover, the anti-CD73 antibodies described herein can be used to purify human CD73 via immunoaffinity purification.

Further encompassed are methods of stimulating an immune response (e.g., an antigen-specific T cell response) in a subject comprising administering an anti-CD73 antibody described herein to the subject such that an immune response (e.g., an antigen-specific T cell response) in the subject is stimulated. In a preferred embodiment, the subject is a tumor-bearing subject and an immune response against the tumor is stimulated. A tumor may be a solid tumor or a liquid tumor, e.g., a hematological malignancy. In certain embodiments, a tumor is an immunogenic tumor. In certain embodiments, a tumor is non-immunogenic.

These and other methods described herein are discussed in further detail below.

Cancer

Inhibition of CD73 by anti-CD73 antibodies can reduce tumor growth and metastasis in a patient. Inhibition of CD73 by anti-CD73 antibodies can also enhance the immune response to cancerous cells in the patient. Provided herein are methods for treating a subject having cancer, comprising administering to the subject an anti-CD73 antibody described herein, such that the subject is treated, e.g., such that growth of cancerous tumors is inhibited or reduced and/or that the tumors regress. An anti-CD73 antibody can be used alone to inhibit the growth of cancerous tumors. Alternatively, an anti-CD73 antibody can be used in conjunction with another agent, e.g., other immunogenic agents, standard cancer treatments, or other antibodies, as described below.

Accordingly, provided herein are methods of treating cancer, e.g., by inhibiting growth of tumor cells, in a subject, comprising administering to the subject a therapeutically effective amount of an anti-CD73 antibody described herein, or antigen-binding portion thereof. The antibody may be a human anti-CD73 antibody (such as any of the human anti-human CD73 antibodies described herein). Additionally or alternatively, the antibody can be a chimeric or humanized anti-CD73 antibody, e.g., a chimeric or humanized anti-CD73 antibody comprising of an anti-CD73 antibody described herein, or antigen-binding portion thereof.

Cancers whose growth may be inhibited using the antibodies of the invention include cancers typically responsive to immunotherapy. Non-limiting examples of cancers for treatment include squamous cell carcinoma, small-cell lung cancer, non-small cell lung cancer, squamous non-small cell lung cancer (NSCLC), non NSCLC, glioma, gastrointestinal cancer, renal cancer (e.g. clear cell carcinoma), ovarian cancer, liver cancer, colorectal cancer, endometrial cancer, kidney cancer (e.g., renal cell carcinoma (RCC)), prostate cancer (e.g. hormone refractory prostate adenocarcinoma), thyroid cancer, neuroblastoma, pancreatic cancer, glioblastoma (glioblastoma multiforme), cervical cancer, stomach cancer, bladder cancer, hepatoma, breast cancer, colon carcinoma, and head and neck cancer (or carcinoma), gastric cancer, germ cell tumor, pediatric sarcoma, sinonasal natural killer, melanoma (e.g., metastatic malignant melanoma, such as cutaneous or intraocular malignant melanoma), bone cancer, skin cancer, uterine cancer, cancer of the anal region, testicular cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the parathyroid gland, cancer of the adrenal gland, sarcoma of soft tissue, cancer of the urethra, cancer of the penis, solid tumors of childhood, cancer of the ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally-induced cancers including those induced by asbestos, virus-related cancers (e.g., human papilloma virus (HPV)-related tumor), and hematologic malignancies derived from either of the two major blood cell lineages, i.e., the myeloid cell line (which produces granulocytes, erythrocytes, thrombocytes, macrophages and mast cells) or lymphoid cell line (which produces B, T, NK and plasma cells), such as all types of luekemias, lymphomas, and myelomas, e.g., acute, chronic, lymphocytic and/or myelogenous leukemias, such as acute leukemia (ALL), acute myelogenous leukemia (AML), chronic lymphocytic leukemia (CLL), and chronic myelogenous leukemia (CML), undifferentiated AML (M0), myeloblastic leukemia (M1), myeloblastic leukemia (M2; with cell maturation), promyelocytic leukemia (M3 or M3 variant [M3V]), myelomonocytic leukemia (M4 or M4 variant with eosinophilia [M4E]), monocytic leukemia (M5), erythroleukemia (M6), megakaryoblastic leukemia (M7), isolated granulocytic sarcoma, and chloroma; lymphomas, such as Hodgkin's lymphoma (HL), non-Hodgkin's lymphoma (NHL), B-cell lymphomas, T-cell lymphomas, lymphoplasmacytoid lymphoma, monocytoid B-cell lymphoma, mucosa-associated lymphoid tissue (MALT) lymphoma, anaplastic (e.g., Ki 1+) large-cell lymphoma, adult T-cell lymphoma/leukemia, mantle cell lymphoma, angio immunoblastic T-cell lymphoma, angiocentric lymphoma, intestinal T-cell lymphoma, primary mediastinal B-cell lymphoma, precursor T-lymphoblastic lymphoma, T-lymphoblastic; and lymphoma/leukaemia (T-Lbly/T-ALL), peripheral T-cell lymphoma, lymphoblastic lymphoma, post-transplantation lymphoproliferative disorder, true histiocytic lymphoma, primary central nervous system lymphoma, primary effusion lymphoma, lymphoblastic lymphoma (LBL), hematopoietic tumors of lymphoid lineage, acute lymphoblastic leukemia, diffuse large B-cell lymphoma, Burkitt's lymphoma, follicular lymphoma, diffuse histiocytic lymphoma (DHL), immunoblastic large cell lymphoma, precursor B-lymphoblastic lymphoma, cutaneous T-cell lymphoma (CTLC) (also called mycosis fungoides or Sezary syndrome), and lymphoplasmacytoid lymphoma (LPL) with Waldenstrom's macroglobulinemia; myelomas, such as IgG myeloma, light chain myeloma, nonsecretory myeloma, smoldering myeloma (also called indolent myeloma), solitary plasmocytoma, and multiple myelomas, chronic lymphocytic leukemia (CLL), hairy cell lymphoma; hematopoietic tumors of myeloid lineage, tumors of mesenchymal origin, including fibrosarcoma and rhabdomyoscarcoma; seminoma, teratocarcinoma, tumors of the central and peripheral nervous, including astrocytoma, schwannomas; tumors of mesenchymal origin, including fibrosarcoma, rhabdomyoscaroma, and osteosarcoma; and other tumors, including melanoma, xeroderma pigmentosum, keratoacanthoma, seminoma, thyroid follicular cancer and teratocarcinoma, hematopoietic tumors of lymphoid lineage, for example T-cell and B-cell tumors, including but not limited to T-cell disorders such as T-prolymphocytic leukemia (T-PLL), including of the small cell and cerebriform cell type; large granular lymphocyte leukemia (LGL) preferably of the T-cell type; a/d T-NHL hepatosplenic lymphoma; peripheral/post-thymic T cell lymphoma (pleomorphic and immunoblastic subtypes); angiocentric (nasal) T-cell lymphoma; cancer of the head or neck, renal cancer, rectal cancer, cancer of the thyroid gland; acute myeloid lymphoma, as well as any combinations of said cancers. The methods described herein may also be used for treatment of metastatic cancers, refractory cancers (e.g., cancers refractory to previous immunotherapy, e.g., with a blocking CTLA-4 or PD-1 or PD-L1 antibody), and recurrent cancers.

The methods may be used for treating tumors or cancers that are CD73 positive, or which express high levels of CD73. A method may comprise first determining the level of CD73 on tumors or tumor cells, and treating with an anti-CD73 antibody, e.g, described herein, if the tumors or cells express CD73, e.g., high levels of CD73.

An anti-CD73 antibody can be administered as a monotherapy, or as the only immunostimulating therapy. Antibodies to CD73, e.g., the anti-CD73 antibodies described herein, can also be combined with an immunogenic agent, such as cancerous cells, purified tumor antigens (including recombinant proteins, peptides, and carbohydrate molecules), cells, and cells transfected with genes encoding immune stimulating cytokines (He et al (2004) *J. Immunol.* 173:4919-28). Non-limiting examples of tumor vaccines that can be used include peptides of melanoma antigens, such as peptides of gp100, MAGE antigens, Trp-2, MART1 and/or tyrosinase, or tumor cells transfected to express the cytokine GM-CSF (discussed further below).

In humans, some tumors have been shown to be immunogenic such as melanomas. By lowering the threshold of T cell activation via CD73 inhibition, the tumor responses in the host can be activated, allowing treatment of non-immunogenic tumors or those having limited immunogenicity.

An anti-CD73 antibody, e.g., an anti-CD73 antibody described herein, may be combined with a vaccination protocol. Many experimental strategies for vaccination against tumors have been devised (see Rosenberg, S., 2000, Development of Cancer Vaccines, ASCO Educational Book Spring: 60-62; Logothetis, C., 2000, ASCO Educational Book Spring: 300-302; Khayat, D. 2000, ASCO Educational Book Spring: 414-428; Foon, K. 2000, ASCO Educational Book Spring: 730-738; see also Restifo, N. and Sznol, M., Cancer Vaccines, Ch. 61, pp. 3023-3043 in DeVita et al. (eds.), 1997, Cancer: Principles and Practice of Oncology, Fifth Edition). In one of these strategies, a vaccine is prepared using autologous or allogeneic tumor cells. These cellular vaccines have been shown to be most effective when the tumor cells are transduced to express GM-CSF. GM-CSF has been shown to be a potent activator of antigen presentation for tumor vaccination (Dranoff et al. (1993) *Proc. Natl. Acad. Sci U.S.A.* 90: 3539-43).

The study of gene expression and large scale gene expression patterns in various tumors has led to the definition of so called tumor specific antigens (Rosenberg, S A (1999) *Immunity* 10: 281-7). In many cases, these tumor specific antigens are differentiation antigens expressed in the tumors and in the cell from which the tumor arose, for example melanocyte antigens gp100, MAGE antigens, and Trp-2. More importantly, many of these antigens can be shown to be the targets of tumor specific T cells found in the host. CD73 inhibition can be used in conjunction with a collection of recombinant proteins and/or peptides expressed in a tumor in order to generate an immune response to these proteins. These proteins are normally viewed by the immune system as self antigens and are therefore tolerant to them. The tumor antigen can include the protein telomerase, which is required for the synthesis of telomeres of chromosomes and which is expressed in more than 85% of human cancers and in only a limited number of somatic tissues (Kim et al. (1994) *Science* 266: 2011-2013). Tumor antigen can also be "neo-antigens" expressed in cancer cells because of somatic mutations that alter protein sequence or create fusion proteins between two unrelated sequences (i.e., bcr-abl in the Philadelphia chromosome), or idiotype from B cell tumors.

Other tumor vaccines can include the proteins from viruses implicated in human cancers such a Human Papilloma Viruses (HPV), Hepatitis Viruses (HBV and HCV) and Kaposi's Herpes Sarcoma Virus (KHSV). Another form of tumor specific antigen which can be used in conjunction with CD73 inhibition is purified heat shock proteins (HSP) isolated from the tumor tissue itself. These heat shock proteins contain fragments of proteins from the tumor cells and these HSPs are highly efficient at delivery to antigen presenting cells for eliciting tumor immunity (Suot & Srivastava (1995) *Science* 269:1585-1588; Tamura et al. (1997) *Science* 278:117-120).

Dendritic cells (DC) are potent antigen presenting cells that can be used to prime antigen-specific responses. DC's can be produced ex vivo and loaded with various protein and peptide antigens as well as tumor cell extracts (Nestle et al. (1998) *Nature Medicine* 4: 328-332). DCs can also be transduced by genetic means to express these tumor antigens as well. DCs have also been fused directly to tumor cells for the purposes of immunization (Kugler et al. (2000) *Nature Medicine* 6:332-336). As a method of vaccination, DC immunization can be effectively combined with CD73 inhibition to activate more potent anti-tumor responses.

CD73 inhibition can also be combined with standard cancer treatments (e.g., surgery, radiation, and chemotherapy). CD73 inhibition can be effectively combined with chemotherapeutic regimes. In these instances, it may be possible to reduce the dose of chemotherapeutic reagent administered (Mokyr et al. (1998) *Cancer Research* 58: 5301-5304). An example of such a combination is an anti-CD73 antibody in combination with decarbazine for the treatment of melanoma. Another example of such a combination is an anti-CD73 antibody in combination with interleukin-2 (IL-2) for the treatment of melanoma. The scientific rationale behind the combined use of CD73 inhibition and chemotherapy is that cell death, that is a consequence of the cytotoxic action of most chemotherapeutic compounds, should result in increased levels of tumor antigen in the antigen presentation pathway. Other combination therapies that may result in synergy with CD73 inhibition through cell death are radiation, surgery, and hormone deprivation. Each of these protocols creates a source of tumor antigen in the host. Angiogenesis inhibitors can also be combined with CD73 inhibition. Inhibition of angiogenesis leads to tumor cell death which may feed tumor antigen into host antigen presentation pathways.

Yet another example of such a combination is an anti-CD73 antibody in combination with an anti-CD39, anti-A2AR or chemical inhibitor, or antiA2BR antibody or chemical inhibitor. The scientific rational behind the combined use of CD73 inhibition and inhibition of CD39, A2AR, or A2BR is that these proteins are also linked to CD73 biological function and signaling. Specifically, CD39 catalyzes the conversion of ATP or ADP to AMP, thus providing the substrate (AMP) for CD73 enzymatic activity (i.e. the conversion of AMP to adenosine). Furthermore, adenosine is a ligand for four known receptors, including A1R, A2AR, A2BR, and A3. A2AR and A2BR have been shown to regulate tumor cell proliferation, growth, migration, and metastasis, as well as T-cell activation in the tumor environment through cAMP signaling.

The anti-CD73 antibodies described herein can also be used in combination with bispecific antibodies that target Fcα or Fcγ receptor-expressing effectors cells to tumor cells (see, e.g., U.S. Pat. Nos. 5,922,845 and 5,837,243). Bispecific antibodies can be used to target two separate antigens. For example anti-Fc receptor/anti tumor antigen (e.g., Her-2/neu) bispecific antibodies have been used to target macrophages to sites of tumor. This targeting may more effectively activate tumor specific responses. Alternatively, antigen may be delivered directly to DCs by the use of bispecific antibodies which bind to tumor antigen and a dendritic cell specific cell surface marker.

Tumors evade host immune surveillance by a large variety of mechanisms. Many of these mechanisms may be overcome by the inactivation of proteins which are expressed by the tumors and which are immunosuppressive. These include among others TGF-β (Kehrl et al. (1986) *J. Exp. Med.* 163: 1037-1050), IL-10 (Howard & O'Garra (1992) *Immunology Today* 13: 198-200), and Fas ligand (Hahne et al. (1996) *Science* 274: 1363-1365). Antibodies to each of these entities can be used in combination with anti-CD73 antibodies to counteract the effects of the immunosuppressive agent and favor tumor immune responses by the host.

Other antibodies which activate host immune responsiveness can be used in combination with anti-CD73 antibodies. These include molecules on the surface of dendritic cells which activate DC function and antigen presentation. Anti-CD40 antibodies are able to substitute effectively for T cell helper activity (Ridge et al. (1998) Nature 393: 474-478) and can be used in conjunction with anti-CD73 antibodies. Activating antibodies to T cell costimulatory molecules such as OX-40 (Weinberg et al. (2000) *Immunol* 164: 2160-2169), 4-1BB (Melero et al. (1997) *Nature Medicine* 3: 682-685 (1997), and ICOS (Hutloff et al. (1999) *Nature* 397: 262-266) may also provide for increased levels of T cell activation. Inhibitors of PD1, PD-L1 or CTLA-4 (e.g., U.S. Pat. No. 5,811,097), may also be used in conjunction with an anti-CD73 antibody.

Other methods described herein are used to treat patients that have been exposed to particular toxins or pathogens. Accordingly, another aspect described herein provides a method of treating an infectious disease in a subject comprising administering to the subject an anti-CD73 antibody, or antigen-binding portion thereof, such that the subject is treated for the infectious disease. Additionally or alternatively, the antibody can be a chimeric or humanized antibody.

In all of the above methods, CD73 inhibition can be combined with other forms of immunotherapy such as cytokine treatment (e.g., interferons, GM-CSF, G-CSF, IL-2), or bispecific antibody therapy, which provides for enhanced presentation of tumor antigens (see, e.g., Holliger (1993) *Proc. Natl. Acad. Sci. USA* 90:6444-6448; Poljak (1994) *Structure* 2:1121-1123).

Combination Therapies

In addition to the combinations therapies provided above, anti-CD73 antibodies described herein can also be used in combination therapy, e.g., for treating cancer, as described below.

Further provided herein are methods of combination therapy in which an anti-CD73 antibody is coadministered with one or more additional agents, e.g., antibodies, that are effective in stimulating immune responses to thereby further enhance, stimulate or upregulate immune responses in a subject.

Generally, an anti-CD73 antibody described herein can be combined with (i) an agonist of a co-stimulatory receptor and/or (ii) an antagonist of an inhibitory signal on T cells, both of which result in amplifying antigen-specific T cell responses (immune checkpoint regulators). Most of the co-stimulatory and co-inhibitory molecules are members of the immunoglobulin super family (IgSF), and anti-CD73 antibodies described herein may be administered with an agent that targets a member of the IgSF family to increase an immune response. One important family of membrane-bound ligands that bind to co-stimulatory or co-inhibitory receptors is the B7 family, which includes B7-1, B7-2, B7-H1 (PD-L1), B7-DC (PD-L2), B7-H2 (ICOS-L), B7-H3, B7-H4, B7-H5 (VISTA), and B7-H6. Another family of membrane bound ligands that bind to co-stimulatory or co-inhibitory receptors is the TNF family of molecules that bind to cognate TNF receptor family members, which include CD40 and CD40L, OX-40, OX-40L, CD70, CD27L, CD30, CD30L, 4-1BBL, CD137, GITR, TRAIL/Apo2-L, TRAILR1/DR4, TRAILR2/DR5, TRAILR3, TRAILR4, OPG, RANK, RANKL, TWEAKR/Fn14, TWEAK, BAFFR, EDAR, XEDAR, TACI, APRIL, BCMA, LTβR, LIGHT, DcR3, HVEM, VEGI/TL1A, TRAMP/DR3, EDAR, EDA1, XEDAR, EDA2, TNFR1, Lymphotoxin α/TNFβ, TNFR2, TNFα, LTβR, Lymphotoxin α1β2, FAS, FASL, RELT, DR6, TROY, NGFR (see, e.g., Tansey (2009) Drug Discovery Today 00:1). T cell activation is also regulated by soluble cytokines. Thus, anti-CD73 antibodies can be used in combination with (i) antagonists (or inhibitors or blocking agents) of proteins of the IgSF family or B7 family or the TNF family that inhibit T cell activation or antagonists of cytokines that inhibit T cell activation (e.g., IL-6, IL-10, TGF-β, VEGF; "immunosuppressive cytokines") and/or (ii) agonists of stimulatory receptors of the IgSF family, B7 family or the TNF family or of cytokines that stimulate T cell activation, for stimulating an immune response, e.g., for treating proliferative diseases, such as cancer.

For example, T cell responses can be stimulated by a combination of anti-CD73 antibodies described herein, e.g., CD73.4-IgG2CS-IgG1.1f, and one or more of the following agents:

(1) An antagonist (inhibitor or blocking agent) of a protein that inhibits T cell activation (e.g., immune checkpoint inhibitors), such as CTLA-4, PD-1, PD-L1, PD-L2, and LAG-3, as described above, and any of the following proteins: TIM-3, Galectin 9, CEACAM-1, BTLA, CD69, Galectin-1, TIGIT, CD113, GPR56, VISTA, 2B4, CD48, GARP, CD73, PD1H, LAIR1, TIM-1, TIM-4, CD39.

(2) An agonist of a protein that stimulates T cell activation, such as B7-1, B7-2, CD28, 4-1BB (CD137), 4-1BBL, GITR, GITRL, ICOS, ICOS-L, OX40, OX40L, CD70, CD27, CD40, DR3 and CD28H.

Exemplary agents that modulate one of the above proteins and may be combined with antagonist anti-CD73 antibodies, e.g., those described herein, for treating cancer, include: Yervoy™ (ipilimumab) or Tremelimumab (to CTLA-4), galiximab (to B7.1), BMS-936558 (to PD-1), CT-011 (to PD-1), MK-3475 (to PD-1), AMP224 (to B7DC), BMS-936559 (to B7-H1), MPDL3280A (to B7-H1), MEDI-570 (to ICOS), AMG557 (to B7H2), MGA271 (to B7H3), IMP321 (to LAG-3), BMS-663513 (to CD137), PF-05082566 (to CD137), CDX-1127 (to CD27), anti-OX40 (Providence Health Services), huMAbOX40L (to OX40L), Atacicept (to TACI), CP-870893 (to CD40), Lucatumumab (to CD40), Dacetuzumab (to CD40), Muromonab-CD3 (to CD3), Ipilumumab (to CTLA-4).

Other molecules that can be combined with antagonist anti-CD73 antibodies for the treatment of cancer include antagonists of inhibitory receptors on NK cells or agonists of activating receptors on NK cells. For example, anti-CD73 antagonist antibodies can be combined with antagonists of KIR (e.g., lirilumab).

T cell activation is also regulated by soluble cytokines, and anti-CD73 antibodies may be administered to a subject, e.g., having cancer, with antagonists of cytokines that inhibit T cell activation or agonists of cytokines that stimulate T cell activation.

In certain embodiments, anti-CD73 antibodies can be used in combination with (i) antagonists (or inhibitors or blocking agents) of proteins of the IgSF family or B7 family or the TNF family that inhibit T cell activation or antagonists of cytokines that inhibit T cell activation (e.g., IL-6, IL-10, TGF-β, VEGF; "immunosuppressive cytokines") and/or (ii) agonists of stimulatory receptors of the IgSF family, B7 family or the TNF family or of cytokines that stimulate T cell activation, for stimulating an immune response, e.g., for treating proliferative diseases, such as cancer.

Yet other agents for combination therapies include agents that inhibit or deplete macrophages or monocytes, including but not limited to CSF-1R antagonists such as CSF-1R antagonist antibodies including RG7155 (WO11/70024, WO11/107553, WO11/131407, WO13/87699, WO13/119716, WO13/132044) or FPA-008 (WO11/140249; WO13169264; WO14/036357).

Anti-CD73 antibodies may also be administered with agents that inhibit TGF-β signaling.

Additional agents that may be combined with an anti-CD73 antibody include agents that enhance tumor antigen presentation, e.g., dendritic cell vaccines, GM-CSF secreting cellular vaccines, CpG oligonucleotides, and imiquimod, or therapies that enhance the immunogenicity of tumor cells (e.g., anthracyclines).

Yet other therapies that may be combined with an anti-CD73 antibody include therapies that deplete or block Treg cells, e.g., an agent that specifically binds to CD25.

Another therapy that may be combined with an anti-CD73 antibody is a therapy that inhibits a metabolic enzyme such as indoleamine dioxigenase (IDO), dioxigenase, arginase, or nitric oxide synthetase.

Another class of agents that may be used with an anti-CD73 antibody includes agents that inhibit the formation of adenosine or inhibit the adenosine A2A receptor.

Other therapies that may be combined with an anti-CD73 antibody for treating cancer include therapies that reverse/prevent T cell anergy or exhaustion and therapies that trigger an innate immune activation and/or inflammation at a tumor site.

An anti-CD73 antibody may be combined with more than one immuno-oncology agent, and may be, e.g., combined with a combinatorial approach that targets multiple elements of the immune pathway, such as one or more of the following: a therapy that enhances tumor antigen presentation (e.g., dendritic cell vaccine, GM-CSF secreting cellular vaccines, CpG oligonucleotides, imiquimod); a therapy that inhibits negative immune regulation e.g., by inhibiting CTLA-4 and/or PD1/PD-L1/PD-L2 pathway and/or depleting or blocking Tregs or other immune suppressing cells; a therapy that stimulates positive immune regulation, e.g., with agonists that stimulate the CD-137, OX-40, and/or GITR pathway and/or stimulate T cell effector function; a therapy that increases systemically the frequency of anti-tumor T cells; a therapy that depletes or inhibits Tregs, such as Tregs in the tumor, e.g., using an antagonist of CD25 (e.g., daclizumab) or by ex vivo anti-CD25 bead depletion; a therapy that impacts the function of suppressor myeloid cells in the tumor; a therapy that enhances immunogenicity of tumor cells (e.g., anthracyclines); adoptive T cell or NK cell transfer including genetically modified cells, e.g., cells modified by chimeric antigen receptors (CAR-T therapy); a therapy that inhibits a metabolic enzyme such as indoleamine dioxigenase (IDO), dioxigenase, arginase, or nitric oxide synthetase; a therapy that reverses/prevents T cell anergy or exhaustion; a therapy that triggers an innate immune activation and/or inflammation at a tumor site; administration of immune stimulatory cytokines; or blocking of immunorepressive cytokines.

Generally, anti-CD73 antibodies described herein can be used together with one or more of agonistic agents that ligate positive costimulatory receptors, blocking agents that attenuate signaling through inhibitory receptors, antagonists, and one or more agents that increase systemically the frequency of anti-tumor T cells, agents that overcome distinct immune suppressive pathways within the tumor microenvironment (e.g., block inhibitory receptor engagement (e.g., PD-L1/PD-1 interactions), deplete or inhibit Tregs (e.g., using an anti-CD25 monoclonal antibody (e.g., daclizumab) or by ex vivo anti-CD25 bead depletion), inhibit metabolic enzymes such as IDO, or reverse/prevent T cell anergy or exhaustion) and agents that trigger innate immune activation and/or inflammation at tumor sites. An increased internalization of inhibitory receptors may translate into a lower level of a potential inhibitor (assuming that signaling does not ensue).

In certain embodiments, an anti-CD73 antibody is administered to a subject together with a BRAF inhibitor if the subject is BRAF V600 mutation positive.

Provided herein are methods for stimulating an immune response in a subject comprising administering to the subject an antagonist anti-CD73 molecule, e.g., an antibody, and one or more additional immunostimulatory antibodies, such as an anti-PD-1 antagonist, e.g., antagonist antibody, an anti-PD-L1 antagonist, e.g., antagonist antibody, an antagonist anti-CTLA-4 antagonist, e.g., antagonist antibody and/or an anti-LAG3 antagonist, e.g., an antagonist antibody, such that an immune response is stimulated in the subject, for example to inhibit tumor growth or to stimulate an anti-viral response. In one embodiment, the subject is administered an antagonist anti-CD73 antibody and an antagonist anti-PD-1 antibody. In one embodiment, the subject is administered an antagonist anti-CD73 antibody and an antagonist anti-PD-L1 antibody. In one embodiment, the subject is administered an antagonist anti-CD73 antibody and an antagonist anti-CTLA-4 antibody. In one embodiment, the anti-CD73 antibody is a human antibody, such as an antibody described herein. Alternatively, the anti-CD73 antibody can be, for example, a chimeric or humanized antibody (e.g., prepared from a mouse anti-CD73 mAb), such as those further described herein. In one embodiment, the at least one additional immunostimulatory antibody (e.g., an antagonist anti-PD-1, an antagonist anti-PD-L1, an antagonist anti-CTLA-4 and/or an antagonist anti-LAG3 antibody) is a human antibody. Alternatively, the at least one additional immunostimulatory antibody can be, for example, a chimeric or humanized antibody (e.g., prepared from a mouse anti-PD-1, anti-PD-L1, anti-CTLA-4 and/or anti-LAG3 antibody).

Provided herein are methods for treating a hyperproliferative disease (e.g., cancer), comprising administering an antagonist anti-CD73 antibody and an antagonist PD-1 antibody to a subject. In certain embodiments, the anti-CD73 antibody is administered at a subtherapeutic dose, the anti-PD-1 antibody is administered at a subtherapeutic dose, or both are administered at a subtherapeutic dose. Also provided herein are methods for altering an adverse event associated with treatment of a hyperproliferative disease with an immunostimulatory agent, comprising administering an anti-CD73 antibody and a subtherapeutic dose of anti-PD-1 antibody to a subject. In certain embodiments, the subject is human. In certain embodiments, the anti-PD-1 antibody is a human sequence monoclonal antibody and the anti-CD73 antibody is human sequence monoclonal antibody, such as an antibody comprising the CDRs or variable regions of 11F11, 4C3, 4D4, 10D2, 11A6, 24H2, 5F8, 6E11, 7A11, CD73.3, CD73.4, CD73.5, CD73.6, CD73.7, CD73.8, CD73.9, CD73.10 or CD73.11 described herein or another antagonist anti-CD73 antibody described herein.

Suitable PD-1 antagonists for use in the methods described herein, include, without limitation, ligands, antibodies (e.g., monoclonal antibodies and bispecific antibodies), and multivalent agents. In one embodiment, the PD-1 antagonist is a fusion protein, e.g., an Fc fusion protein, such as AMP-244. In one embodiment, the PD-1 antagonist is an anti-PD-1 or anti-PD-L1 antibody.

An exemplary anti-PD-1 antibody is nivolumab (BMS-936558) or an antibody that comprises the CDRs or variable regions of one of antibodies 17D8, 2D3, 4H1, 5C4, 7D3, 5F4 and 4A11 described in WO 2006/121168. In certain embodiments, an anti-PD1 antibody is MK-3475 (Lambrolizumab) described in WO2012/145493; AMP-514 described in WO 2012/145493; and CT-011 (Pidilizumab; previously CT-AcTibody or BAT; see, e.g., Rosenblatt et al. (2011) J. Immunotherapy 34:409). Further known PD-1 antibodies and other PD-1 inhibitors include those described in WO 2009/014708, WO 03/099196, WO 2009/114335, WO 2011/066389, WO 2011/161699, WO 2012/145493, U.S. Pat. Nos. 7,635,757 and 8,217,149, and U.S. Patent Publication No. 2009/0317368. Any of the anti-PD-1 antibodies disclosed in WO2013/173223 may also be used. An anti-PD-1 antibody that competes for binding with, and/or binds to the same epitope on PD-1 as, as one of these antibodies may also be used in combination treatments.

In certain embodiments, the anti-PD-1 antibody binds to human PD-1 with a $K_D$ of $5 \times 10^{-8}$M or less, binds to human PD-1 with a $K_D$ of $1\times10^{-8}$M or less, binds to human PD-1 with a $K_D$ of $5\times10^{-9}$M or less, or binds to human PD-1 with a $K_D$ of between $1\times10^{-8}$M and $1\times10^{-10}$ M or less.

Provided herein are methods for treating a hyperproliferative disease (e.g., cancer), comprising administering an antagonist anti-CD73 antibody and an antagonist PD-L1 antibody to a subject. In certain embodiments, the anti-CD73 antibody is administered at a subtherapeutic dose, the anti-PD-L1 antibody is administered at a subtherapeutic dose, or both are administered at a subtherapeutic dose. Provided herein are methods for altering an adverse event associated with treatment of a hyperproliferative disease with an immunostimulatory agent, comprising administering an anti-CD73 antibody and a subtherapeutic dose of anti-PD-L1 antibody to a subject. In certain embodiments, the subject is human. In certain embodiments, the anti-PD-L1 antibody is a human sequence monoclonal antibody and the anti-CD73 antibody is human sequence monoclonal antibody, such as an antibody comprising the CDRs or variable regions of 11F11, 4C3, 4D4, 10D2, 11A6, 24H2, 5F8, 6E11, 7A11, CD73.3, CD73.4, CD73.5, CD73.6, CD73.7, CD73.8, CD73.9, CD73.10 or CD73.11 described herein or another antagonist anti-CD73 antibody described herein.

In one embodiment, the anti-PD-L1 antibody is BMS-936559 (referred to as 12A4 in WO 2007/005874 and U.S. Pat. No. 7,943,743), or an antibody that comprises the CDRs or variable regions of 3G10, 12A4, 10A5, 5F8, 10H10, 1B12, 7H1, 11E6, 12B7 and 13G4, which are described in PCT Publication WO 07/005874 and U.S. Pat. No. 7,943, 743. In certain embodiment an anti-PD-L1 antibody is MEDI4736 (also known as Anti-B7-H1) or MPDL3280A (also known as RG7446). Any of the anti-PD-L1 antibodies disclosed in WO2013/173223, WO2011/066389, WO2012/145493, U.S. Pat. Nos. 7,635,757 and 8,217,149 and U.S. Publication No. 2009/145493 may also be used. Anti-PD-L1 antibodies that compete with and/or bind to the same epitope as that of any of these antibodies may also be used in combination treatments.

In certain embodiments, the anti-PD-L1 antibody binds to human PD-L1 with a $K_D$ of $5\times10^{-8}$M or less, binds to human PD-L1 with a $K_D$ of $1\times10^{-8}$M or less, binds to human PD-L1 with a $K_D$ of $5\times10^{-9}$M or less, or binds to human PD-L1 with a $K_D$ of between $1\times10^{-8}$M and $1\times10^{-10}$M or less.

Provided herein are methods for treating a hyperproliferative disease (e.g., cancer), comprising administering an anti-CD73 antibody described herein and a CTLA-4 antagonist antibody to a subject. In certain embodiments, the anti-CD73 antibody is administered at a subtherapeutic dose, the anti-CTLA-4 antibody is administered at a subtherapeutic dose, or both are administered at a subtherapeutic dose. Provided herein are methods for altering an adverse event associated with treatment of a hyperproliferative disease with an immunostimulatory agent, comprising administering an anti-CD73 antibody and a subtherapeutic dose of anti-CTLA-4 antibody to a subject. In certain embodiments, the subject is human. In certain embodiments, the anti-CTLA-4 antibody is an antibody selected from the group of: Yervoy™ (ipilimumab or antibody 10D1, described in PCT Publication WO 01/14424), tremelimumab (formerly ticilimumab, CP-675,206), monoclonal or an anti-CTLA-4 antibody described in any of the following publications: WO 98/42752; WO 00/37504; U.S. Pat. No. 6,207,156; Hurwitz et al. (1998) *Proc. Natl. Acad. Sci. USA* 95(17):10067-10071; Camacho et al. (2004) *J. Clin. Oncology* 22(145): Abstract No. 2505 (antibody CP-675206); and Mokyr et al. (1998) *Cancer Res.* 58:5301-5304. Any of the anti-CTLA-4 antibodies disclosed in WO2013/173223 may also be used.

In certain embodiments, the anti-CTLA-4 antibody binds to human CTLA-4 with a $K_D$ of $5\times10^{-8}$M or less, binds to human CTLA-4 with a $K_D$ of $1\times10^{-8}$M or less, binds to human CTLA-4 with a $K_D$ of $5\times10^{-9}$M or less, or binds to human CTLA-4 with a $K_D$ of between $1\times10^{-8}$M and $1\times10^{-10}$M or less.

Provided herein are methods for treating a hyperproliferative disease (e.g., cancer), comprising administering an anti-CD73 antibody and an anti-LAG-3 antibody to a subject. In further embodiments, the anti-CD73 antibody is administered at a subtherapeutic dose, the anti-LAG-3 antibody is administered at a subtherapeutic dose, or both are administered at a subtherapeutic dose. Provide herein are methods for altering an adverse event associated with treatment of a hyperproliferative disease with an immunostimulatory agent, comprising administering an anti-CD73 antibody and a subtherapeutic dose of anti-LAG-3 antibody to a subject. In certain embodiments, the subject is human. In certain embodiments, the anti-PD-L1 antibody is a human sequence monoclonal antibody and the anti-CD73 antibody is human sequence monoclonal antibody, such as an antibody comprising the CDRs or variable regions of 11F11, 4C3, 4D4, 10D2, 11A6, 24H2, 5F8, 6E11, 7A11, CD73.3, CD73.4, CD73.5, CD73.6, CD73.7, CD73.8, CD73.9, CD73.10 or CD73.11 or another antagonist anti-CD73 antibody described herein. Examples of anti-LAGS antibodies include antibodies comprising the CDRs or variable regions of antibodies 25F7, 26H10, 25E3, 8B7, 11F2 or 17E5, which are described in U.S. Patent Publication No. US2011/0150892 and WO2014/008218. In one embodiment, an anti-LAG-3 antibody is BMS-986016. Other art recognized anti-LAG-3 antibodies that can be used include IMP731 described in US 2011/007023. IMP-321 may also be used. Anti-LAG-3 antibodies that compete with and/or bind to the same epitope as that of any of these antibodies may also be used in combination treatments.

In certain embodiments, the anti-LAG-3 antibody binds to human LAG-3 with a $K_D$ of $5\times10^{-8}$M or less, binds to human LAG-3 with a $K_D$ of $1\times10^{-8}$M or less, binds to human LAG-3 with a $K_D$ of $5\times10^{-9}$M or less, or binds to human LAG-3 with a $K_D$ of between $1\times10^{-8}$M and $1\times10^{-10}$ M or less.

In certain embodiments, the anti-CD73 antibody is administered together with an anti-GITR agonist antibody, e.g., an antibody having the CDR sequences of 6C8, e.g., a humanized antibody having the CDRs of 6C8, as described, e.g., in WO2006/105021; an antibody comprising the CDRs of an anti-GITR antibody described in WO2011/028683; an antibody comprising the CDRs of an anti-GITR antibody described in JP2008278814; or an antibody comprising the CDRs of an anti-GITR antibody described in PCT/US2015/033991.

Administration of anti-CD73 antibodies described herein and antagonists, e.g., antagonist antibodies, to one or more second target antigens such as LAG-3 and/or CTLA-4 and/or PD-1 and/or PD-L1 can enhance the immune response to cancerous cells in the patient. Cancers whose growth may be inhibited using the antibodies of the instant disclosure include cancers typically responsive to immunotherapy. Representative examples of cancers for treatment with the combination therapy of the instant disclosure include those cancers specifically listed above in the discussion of monotherapy with anti-CD73 antibodies.

In certain embodiments, the combination of therapeutic antibodies discussed herein can be administered concurrently as a single composition in a pharmaceutically acceptable carrier, or concurrently as separate compositions with each antibody in a pharmaceutically acceptable carrier. In another embodiment, the combination of therapeutic antibodies can be administered sequentially. For example, an anti-CTLA-4 antibody and an anti-CD73 antibody can be administered sequentially, such as anti-CTLA-4 antibody being administered first and anti-CD73 antibody second, or anti-CD73 antibody being administered first and anti-CTLA-4 antibody second. Additionally or alternatively, an anti-PD-1 antibody and an anti-CD73 antibody can be administered sequentially, such as anti-PD-1 antibody being administered first and anti-CD73 antibody second, or anti-CD73 antibody being administered first and anti-PD-1 antibody second. Additionally or alternatively, an anti-PD-L1 antibody and an anti-CD73 antibody can be administered sequentially, such as anti-PD-L1 antibody being administered first and anti-CD73 antibody second, or anti-CD73 antibody being administered first and anti-PD-L1 antibody second. Additionally or alternatively, an anti-LAG-3 antibody and an anti-CD73 antibody can be administered sequentially, such as anti-LAG-3 antibody being administered first and anti-CD73 antibody second, or anti-CD73 antibody being administered first and anti-LAG-3 antibody second.

Furthermore, if more than one dose of the combination therapy is administered sequentially, the order of the sequential administration can be reversed or kept in the same order at each time point of administration, sequential administrations can be combined with concurrent administrations, or any combination thereof. For example, the first administration of a combination anti-CTLA-4 antibody and anti-CD73 antibody can be concurrent, the second administration can be sequential with anti-CTLA-4 antibody first and anti-CD73 antibody second, and the third administration can be sequential with anti-CD73 antibody first and anti-CTLA-4 antibody second, etc. Additionally or alternatively, the first administration of a combination anti-PD-1 antibody and anti-CD73 antibody can be concurrent, the second administration can be sequential with anti-PD-1 antibody first and anti-CD73 antibody second, and the third administration can be sequential with anti-CD73 antibody first and anti-PD-1 antibody second, etc. Additionally or alternatively, the first administration of a combination anti-PD-L1 antibody and anti-CD73 antibody can be concurrent, the second administration can be sequential with anti-PD-L1 antibody first and anti-CD73 antibody second, and the third administration can be sequential with anti-CD73 antibody first and anti-PD-L1 antibody second, etc. Additionally or alternatively, the first administration of a combination anti-LAG-3 antibody and anti-CD73 antibody can be concurrent, the second administration can be sequential with anti-LAG-3 antibody first and anti-CD73 antibody second, and the third administration can be sequential with anti-CD73 antibody first and anti-LAG-3 antibody second, etc. Another representative dosing scheme can involve a first administration that is sequential with anti-CD73 first and anti-CTLA-4 antibody (and/or anti-PD-1 antibody and/or anti-PD-L1 antibody and/or anti-LAG-3 antibody) second, and subsequent administrations may be concurrent.

In one embodiment, a subject having a disease that may benefit from stimulation of the immune system, e.g., cancer or an infectious disease, is treated by administration to the subject of an immune-oncology agent and an anti-CD73 antibody, wherein the immune-oncology agent is a CD137 (4-1BB) agonist, such as an agonistic CD137 antibody. Suitable CD137 antibodies include, for example, urelumab or PF-05082566 (WO12/32433).

In one embodiment, a subject having a disease that may benefit from stimulation of the immune system, e.g., cancer or an infectious disease, is treated by administration to the subject of an immune-oncology agent and an anti-CD73 antibody, wherein the immuno-oncology agent is an OX40 agonist, such as an agonistic OX40 antibody. Suitable OX40 antibodies include, for example, MEDI-6383, MEDI-6469 or MOXR0916 (RG7888; WO06/029879).

In one embodiment, a subject having a disease that may benefit from stimulation of the immune system, e.g., cancer or an infectious disease, is treated by administration to the subject of an immune-oncology agent and an anti-CD73 antibody, wherein the immuno-oncology agent is a CD40 agonist, such as an agonistic CD40 antibody. In certain embodiments, the immuno-oncology agent is a CD40 antagonist, such as an antagonistic CD40 antibody. Suitable CD40 antibodies include, for example, lucatumumab (HCD122), dacetuzumab (SGN-40), CP-870,893 or Chi Lob 7/4.

In one embodiment, a subject having a disease that may benefit from stimulation of the immune system, e.g., cancer or an infectious disease, is treated by administration to the subject of an immune-oncology agent and an anti-CD73 antibody, wherein the immuno-oncology agent is a CD27 agonist, such as an agonistic CD27 antibody. Suitable CD27 antibodies include, for example, varlilumab (CDX-1127).

In one embodiment, a subject having a disease that may benefit from stimulation of the immune system, e.g., cancer or an infectious disease, is treated by administration to the subject of an immune-oncology agent and an anti-CD73 antibody, wherein the immuno-oncology agent is MGA271 (to B7H3) (WO11/109400).

In one embodiment, a subject having a disease that may benefit from stimulation of the immune system, e.g., cancer or an infectious disease, is treated by administration to the subject of an immune-oncology agent and an anti-CD73 antibody, wherein the immuno-oncology agent is a KIR antagonist, such as lirilumab.

In one embodiment, a subject having a disease that may benefit from stimulation of the immune system, e.g., cancer or an infectious disease, is treated by administration to the subject of an immune-oncology agent and an anti-CD73 antibody, wherein the immuno-oncology agent is an IDO antagonist. Suitable IDO antagonists include, for example, INCB-024360 (WO2006/122150, WO07/75598, WO08/36653, WO08/36642), indoximod, NLG-919 (WO09/73620, WO09/1156652, WO11/56652, WO12/142237) or F001287.

In one embodiment, a subject having a disease that may benefit from stimulation of the immune system, e.g., cancer or an infectious disease, is treated by administration to the subject of an immune-oncology agent and an anti-CD73 antibody, wherein the immuno-oncology agent is a Toll-like receptor agonist, e.g., a TLR2/4 agonist (e.g., Bacillus Calmette-Guerin); a TLR7 agonist (e.g., Hiltonol or Imiquimod); a TLR7/8 agonist (e.g., Resiquimod); or a TLR9 agonist (e.g., CpG7909).

In one embodiment, a subject having a disease that may benefit from stimulation of the immune system, e.g., cancer or an infectious disease, is treated by administration to the subject of an immune-oncology agent and an anti-CD73 antibody, wherein, the immuno-oncology agent is a TGF-$\beta$ inhibitor, e.g., GC1008, LY2157299, TEW7197, or IMC-TR1.

In one aspect, an anti-CD73 antibody is sequentially administered prior to administration of a second agent, e.g., an immuno-oncology agent. In one aspect, an anti-CD73 antibody is administered concurrently with the second agent, e.g., an immunology-oncology agent. In yet one aspect, an anti-CD73 antibody is sequentially administered after administration of the second agent. The administration of the two agents may start at times that are, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks apart, or administration of the second agent may start, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks after the first agent has been administered.

In certain aspects, an anti-CD73 antibody and a second agent, e.g., an immuno-oncology agent, are administered simultaneously, e.g., are infused simultaneously, e.g., over a period of 30 or 60 minutes, to a patient. An anti-CD73 antibody may be co-formulated with a second agent, e.g., an immuno-oncology agent.

Optionally, an anti-CD73 as sole immunotherapeutic agent, or the combination of an anti-CD73 antibody and one or more additional immunotherapeutic antibodies (e.g., anti-CTLA-4 and/or anti-PD-1 and/or anti-PD-L1 and/or anti-LAG-3 blockade) can be further combined with an immunogenic agent, such as cancerous cells, purified tumor antigens (including recombinant proteins, peptides, and carbohydrate molecules), cells, and cells transfected with genes encoding immune stimulating cytokines (He et al. (2004) *J. Immunol.* 173:4919-28). Non-limiting examples of tumor vaccines that can be used include peptides of melanoma antigens, such as peptides of gp100, MAGE antigens, Trp-2, MART1 and/or tyrosinase, or tumor cells transfected to express the cytokine GM-CSF (discussed further below). A combined CD73 inhibition and one or more additional antibodies (e.g., CTLA-4 and/or PD-1 and/or PD-L1 and/or LAG-3 blockade) can also be further combined with standard cancer treatments. For example, a combined CD73 inhibition and one or more additional antibodies (e.g., CTLA-4 and/or PD-1 and/or PD-L1 and/or LAG-3 blockade) can be effectively combined with chemotherapeutic regimes. In these instances, it is possible to reduce the dose of other chemotherapeutic reagent administered with the combination of the instant disclosure (Mokyr et al. (1998) *Cancer Research* 58: 5301-5304). An example of such a combination is a combination of anti-CD73 antagonist antibody with or without and an additional antibody, such as anti-CTLA-4 antibodies and/or anti-PD-1 antibodies and/or anti-PD-L1 antibodies and/or anti-LAG-3 antibodies) further in combination with decarbazine for the treatment of melanoma. Another example is a combination of anti-CD73 antibody with or without and anti-CTLA-4 antibodies and/or anti-PD-1 antibodies and/or anti-PD-L1 antibodies and/or LAG-3 antibodies further in combination with interleukin-2 (IL-2) for the treatment of melanoma. The scientific rationale behind the combined use of CD73 inhibition and CTLA-4 and/or PD-1 and/or PD-L1 and/or LAG-3 blockade with chemotherapy is that cell death, which is a consequence of the cytotoxic action of most chemotherapeutic compounds, should result in increased levels of tumor antigen in the antigen presentation pathway. Other combination therapies that may result in synergy with a combined CD73 inhibition with or without and CTLA-4 and/or PD-1 and/or PD-L1 and/or LAG-3 blockade through cell death include radiation, surgery, or hormone deprivation. Each of these protocols creates a source of tumor antigen in the host. Angiogenesis inhibitors can also be combined with a combined CD73 inhibition and CTLA-4 and/or PD-1 and/or PD-L1 and/or LAG-3 blockade. Inhibition of angiogenesis leads to tumor cell death, which can be a source of tumor antigen fed into host antigen presentation pathways.

An anti-CD73 antagonist antibody as sole immunotherapeutic agent, or a combination of CD73 antagonistic and CTLA-4 and/or PD-1 and/or PD-L1 and/or LAG-3 blocking antibodies can also be used in combination with bispecific antibodies that target Fcα or Fcγ receptor-expressing effector cells to tumor cells (see, e.g., U.S. Pat. Nos. 5,922,845 and 5,837,243). Bispecific antibodies can be used to target two separate antigens. The T cell arm of these responses would be augmented by the use of a combined CD73 inhibition and CTLA-4 and/or PD-1 and/or PD-L1 and/or LAG-3 blockade.

In another example, an anti-CD73 antagonist antibody as sole immunotherapeutic agent or a combination of an anti-CD73 antibody and additional immunostimulating agent, e.g., anti-CTLA-4 antibody and/or anti-PD-1 antibody and/or anti-PD-L1 antibody and/or LAG-3 agent, e.g., antibody, can be used in conjunction with an anti-neoplastic antibody, such as Rituxan® (rituximab), Herceptin® (trastuzumab), Bexxar® (tositumomab), Zevalin® (ibritumomab), Campath® (alemtuzumab), Lymphocide® (eprtuzumab), Avastin® (bevacizumab), and Tarceva® (erlotinib), and the like. By way of example and not wishing to be bound by theory, treatment with an anti-cancer antibody or an anti-cancer antibody conjugated to a toxin can lead to cancer cell death (e.g., tumor cells) which would potentiate an immune response mediated by the immunostimulating agent, e.g., CD73, CTLA-4, PD-1, PD-L1 or LAG-3 agent, e.g., antibody. In an exemplary embodiment, a treatment of a hyperproliferative disease (e.g., a cancer tumor) can include an anti-cancer agent, e.g., antibody, in combination with anti-CD73 and optionally an additional immunostimulating agent, e.g., anti-CTLA-4 and/or anti-PD-1 and/or anti-PD-L1 and/or anti-LAG-3 agent, e.g., antibody, concurrently or sequentially or any combination thereof, which can potentiate an anti-tumor immune responses by the host.

Tumors evade host immune surveillance by a large variety of mechanisms. Many of these mechanisms may be overcome by the inactivation of proteins, which are expressed by the tumors and which are immunosuppressive. These include, among others, TGF-β (Kehrl et al. (1986) *J. Exp. Med.* 163: 1037-1050), IL-10 (Howard & O'Garra (1992) *Immunology Today* 13: 198-200), and Fas ligand (Hahne et al. (1996) *Science* 274: 1363-1365). Antibodies to each of these entities can be further combined with an anti-CD73 antibody with or without an additional immunostimulating agent, e.g., an anti-CTLA-4 and/or anti-PD-1 and/or anti-PD-L1 and/or anti-LAG-3 agent, such as antibody, to counteract the effects of immunosuppressive agents and favor anti-tumor immune responses by the host.

Other agents, e.g., antibodies, that can be used to activate host immune responsiveness can be further used in combination with an anti-CD73 antibody with or without an additional immunostimulating agent, such as anti-CTLA-4 and/or anti-PD-1 and/or anti-PD-L1 and/or anti-LAG-3 antibody. These include molecules on the surface of dendritic cells that activate DC function and antigen presentation. Anti-CD40 antibodies (Ridge et al., supra) can be used in conjunction with an anti-CD73 antibody and optionally an additional immunostimulating agent, e.g., an anti-CTLA-4 and/or anti-PD-1 and/or anti-PD-L1 and/or anti-LAG-3 agent, e.g., antibody. Other activating antibodies to T cell costimulatory molecules Weinberg et al., supra, Melero et al. supra, Hutloff et al., supra, may also provide for increased levels of T cell activation.

As discussed above, bone marrow transplantation is currently being used to treat a variety of tumors of hematopoietic origin. Anti-CD73 immunotherapy alone or combined with CTLA-4 and/or PD-1 and/or PD-L1 and/or LAG-3 blockade can be used to increase the effectiveness of the donor engrafted tumor specific T cells.

Several experimental treatment protocols involve ex vivo activation and expansion of antigen specific T cells and adoptive transfer of these cells into recipients in order to antigen-specific T cells against tumor (Greenberg & Riddell, supra). These methods can also be used to activate T cell responses to infectious agents such as CMV. Ex vivo activation in the presence of anti-CD73 with or without an additional immunostimulating therapy, e.g., anti-CTLA-4 and/or anti-PD-1 and/or anti-PD-L1 and/or anti-LAG-3 antibodies can be expected to increase the frequency and activity of the adoptively transferred T cells.

Provided herein are methods for altering an adverse event associated with treatment of a hyperproliferative disease (e.g., cancer) with an immunostimulatory agent, comprising administering an anti-CD73 antibody with or without and a subtherapeutic dose of anti-CTLA-4 and/or anti-PD-1 and/or anti-PD-L1 and/or anti-LAG-3 agent, e.g., antibody, to a subject. For example, the methods described herein provide for a method of reducing the incidence of immunostimulatory therapeutic antibody-induced colitis or diarrhea by administering a non-absorbable steroid to the patient. As used herein, a "non-absorbable steroid" is a glucocorticoid that exhibits extensive first pass metabolism such that, following metabolism in the liver, the bioavailability of the steroid is low, i.e., less than about 20%. In one embodiment described herein, the non-absorbable steroid is budesonide. Budesonide is a locally-acting glucocorticosteroid, which is extensively metabolized, primarily by the liver, following oral administration. ENTOCORT EC® (Astra-Zeneca) is a pH- and time-dependent oral formulation of budesonide developed to optimize drug delivery to the ileum and throughout the colon. ENTOCORT EC® is approved in the U.S. for the treatment of mild to moderate Crohn's disease involving the ileum and/or ascending colon. The usual oral dosage of ENTOCORT EC® for the treatment of Crohn's disease is 6 to 9 mg/day. ENTOCORT EC® is released in the intestines before being absorbed and retained in the gut mucosa. Once it passes through the gut mucosa target tissue, ENTOCORT EC® is extensively metabolized by the cytochrome P450 system in the liver to metabolites with negligible glucocorticoid activity. Therefore, the bioavailability is low (about 10%). The low bioavailability of budesonide results in an improved therapeutic ratio compared to other glucocorticoids with less extensive first-pass metabolism. Budesonide results in fewer adverse effects, including less hypothalamic-pituitary suppression, than systemically-acting corticosteroids. However, chronic administration of ENTOCORT EC® can result in systemic glucocorticoid effects such as hypercorticism and adrenal suppression. See PDR 58$^{th}$ ed. 2004; 608-610.

In still further embodiments, a CD73 inhibition with or without CTLA-4 and/or PD-1 and/or PD-L1 and/or LAG-3 blockade (i.e., immunostimulatory therapeutic antibodies anti-CD73 and optionally anti-CTLA-4 and/or anti-PD-1 and/or anti-PD-L1 and/or anti-LAG-3 antibodies) in conjunction with a non-absorbable steroid can be further combined with a salicylate. Salicylates include 5-ASA agents such as, for example: sulfasalazine (AZULFIDINE®, Pharmacia & UpJohn); olsalazine (DIPENTUM®, Pharmacia & UpJohn); balsalazide (COLAZAL®, Salix Pharmaceuticals, Inc.); and mesalamine (ASACOL®, Procter & Gamble Pharmaceuticals; PENTASA®, Shire US; CANASA®, Axcan Scandipharm, Inc.; ROWASA®, Solvay).

In accordance with the methods described herein, a salicylate administered in combination with anti-CD73 with or without anti-CTLA-4 and/or anti-PD-1 and/or anti-PD-L1 and/or LAG-3 antibodies and a non-absorbable steroid can includes any overlapping or sequential administration of the salicylate and the non-absorbable steroid for the purpose of decreasing the incidence of colitis induced by the immunostimulatory antibodies. Thus, for example, methods for reducing the incidence of colitis induced by the immunostimulatory antibodies described herein encompass administering a salicylate and a non-absorbable concurrently or sequentially (e.g., a salicylate is administered 6 hours after a non-absorbable steroid), or any combination thereof. Further, a salicylate and a non-absorbable steroid can be administered by the same route (e.g., both are administered orally) or by different routes (e.g., a salicylate is administered orally and a non-absorbable steroid is administered rectally), which may differ from the route(s) used to administer the anti-CD73 and anti-CTLA-4 and/or anti-PD-1 and/or anti-PD-L1 and/or anti-LAG-3 antibodies.

The anti-CD73 antibodies and combination antibody therapies described herein may also be used in conjunction with other well known therapies that are selected for their particular usefulness against the indication being treated (e.g., cancer). Combinations of the anti-CD73 antibodies described herein may be used sequentially with known pharmaceutically acceptable agent(s).

For example, the anti-CD73 antibodies and combination antibody therapies described herein can be used in combination (e.g., simultaneously or separately) with an additional treatment, such as irradiation, chemotherapy (e.g., using camptothecin (CPT-11), 5-fluorouracil (5-FU), cisplatin, doxorubicin, irinotecan, paclitaxel, gemcitabine, cisplatin, paclitaxel, carboplatin-paclitaxel (Taxol), doxorubicin, 5-fu, or camptothecin+apo21/TRAIL (a 6X combo)), one or more proteasome inhibitors (e.g., bortezomib or MG132), one or more Bcl-2 inhibitors (e.g., BH3I-2' (bcl-xl inhibitor), indoleamine dioxygenase-1 (IDO1) inhibitor (e.g., INCB24360), AT-101 (R-(−)-gossypol derivative), ABT-263 (small molecule), GX-15-070 (obatoclax), or MCL-1 (myeloid leukemia cell differentiation protein-1) antagonists), iAP (inhibitor of apoptosis protein) antagonists (e.g., smac7, smac4, small molecule smac mimetic, synthetic smac peptides (see Fulda et al., *Nat Med* 2002; 8:808-15), ISIS23722 (LY2181308), or AEG-35156 (GEM-640)), HDAC (histone deacetylase) inhibitors, anti-CD20 antibodies (e.g., rituximab), angiogenesis inhibitors (e.g., bevacizumab), anti-angiogenic agents targeting VEGF and VEGFR (e.g., Avastin), synthetic triterpenoids (see Hyer et al., Cancer Research 2005; 65:4799-808), c-FLIP (cellular FLICE-inhibitory protein) modulators (e.g., natural and synthetic ligands of PPARγ (peroxisome proliferator-activated receptor γ), 5809354 or 5569100), kinase inhibitors (e.g., Sorafenib), Trastuzumab, Cetuximab, Temsirolimus, mTOR inhibitors such as rapamycin and temsirolimus, Bortezomib, JAK2 inhibitors, HSP90 inhibitors, PI3K-AKT inhibitors, Lenalildomide, GSK3β inhibitors, IAP inhibitors and/or genotoxic drugs.

The anti-CD73 antibodies and combination antibody therapies described herein can further be used in combination with one or more anti-proliferative cytotoxic agents.

Classes of compounds that may be used as anti-proliferative cytotoxic agents include, but are not limited to, the following:

Alkylating agents (including, without limitation, nitrogen mustards, ethylenimine derivatives, alkyl sulfonates, nitrosoureas and triazenes): Uracil mustard, Chlormethine, Cyclophosphamide (CYTOXAN™) fosfamide, Melphalan, Chlorambucil, Pipobroman, Triethylenemelamine, Triethylenethiophosphoramine, Busulfan, Carmustine, Lomustine, Streptozocin, Dacarbazine, and Temozolomide.

Antimetabolites (including, without limitation, folic acid antagonists, pyrimidine analogs, purine analogs and adenosine deaminase inhibitors): Methotrexate, 5-Fluorouracil, Floxuridine, Cytarabine, 6-Mercaptopurine, 6-Thioguanine, Fludarabine phosphate, Pentostatine, and Gemcitabine.

Suitable anti-proliferative agents for combining with antagonist anti-CD73 antibodies, without limitation, taxanes, paclitaxel (paclitaxel is commercially available as TAXOL™), docetaxel, discodermolide (DDM), dictyostatin (DCT), Peloruside A, epothilones, epothilone A, epothilone B, epothilone C, epothilone D, epothilone E, epothilone F, furanoepothilone D, desoxyepothilone B1, [17]-dehydrodesoxyepothilone B, [18]dehydrodesoxyepothilones B, C12,13-cyclopropyl-epothilone A, C6-C8 bridged epothilone A, trans-9,10-dehydroepothilone D, cis-9,10-dehydroepothilone D, 16-desmethylepothilone B, epothilone B 10, discoderomolide, patupilone (EPO-906), KOS-862, KOS-1584, ZK-EPO, ABJ-789, XAA296A (Discodermolide), TZT-1027 (soblidotin), ILX-651 (tasidotin hydrochloride), Halichondrin B, Eribulin mesylate (E-7389), Hemiasterlin (HTI-286), E-7974, Cyrptophycins, LY-355703, Maytansinoid immunoconjugates (DM-1), MKC-1, ABT-751, T1-38067, T-900607, SB-715992 (ispinesib), SB-743921, MK-0731, STA-5312, eleutherobin, 17beta-acetoxy-2-ethoxy-6-oxo-B-homo-estra-1,3,5(10)-trien-3-ol, cyclostreptin, isolaulimalide, laulimalide, 4-epi-7-dehydroxy-14,16-didemethyl-(+)-discodermolides, and cryptothilone 1, in addition to other microtubuline stabilizing agents known in the art.

In cases where it is desirable to render aberrantly proliferative cells quiescent in conjunction with or prior to treatment with anti-CD73 antibodies described herein, hormones and steroids (including synthetic analogs), such as 17a-Ethinylestradiol, Diethylstilbestrol, Testosterone, Prednisone, Fluoxymesterone, Dromostanolone propionate, Testolactone, Megestrolacetate, Methylprednisolone, Methyltestosterone, Prednisolone, Triamcinolone, Chlorotrianisene, Hydroxyprogesterone, Aminoglutethimide, Estramustine, Medroxyprogesteroneacetate, Leuprolide, Flutamide, Toremifene, ZOLADEX™, can also be administered to the patient. When employing the methods or compositions described herein, other agents used in the modulation of tumor growth or metastasis in a clinical setting, such as antimimetics, can also be administered as desired.

Methods for the safe and effective administration of chemotherapeutic agents are known to those skilled in the art. In addition, their administration is described in the standard literature. For example, the administration of many of the chemotherapeutic agents is described in the Physicians' Desk Reference (PDR), e.g., 1996 edition (Medical Economics Company, Montvale, N.J. 07645-1742, USA); the disclosure of which is incorporated herein by reference thereto.

The chemotherapeutic agent(s) and/or radiation therapy can be administered according to therapeutic protocols well known in the art. It will be apparent to those skilled in the art that the administration of the chemotherapeutic agent(s) and/or radiation therapy can be varied depending on the disease being treated and the known effects of the chemotherapeutic agent(s) and/or radiation therapy on that disease. Also, in accordance with the knowledge of the skilled clinician, the therapeutic protocols (e.g., dosage amounts and times of administration) can be varied in view of the observed effects of the administered therapeutic agents on the patient, and in view of the observed responses of the disease to the administered therapeutic agents.

EXEMPLARY EMBODIMENTS

1. An isolated human antibody, or antigen binding portion thereof, which binds to human Cluster of Differentiation 73 (CD73) and exhibits one or more of the following properties:
   (a) inhibits CD73 enzymatic activity;
   (b) internalizes into tumor cells or
   (c) binds to a conformation epitope comprising amino acids 65-83 and 157-172 of human CD73.
2. The antibody, or antigen binding portion thereof, of embodiment 1, wherein the antibody internalizes into tumor cells with a $T_{1/2}$ of no more than 10 min as measured by Pulse Chase.
3. The antibody, or antigen binding portion thereof, of embodiment 1 or 2, wherein the antibody binds to soluble human CD73 with a $K_D$ of about 0.1 to 10 nM or less as measured by BIACORE® SPR analysis.
4. The antibody, or antigen binding portion thereof, of any one of the preceding embodiments, wherein the antibody binds to human CD73 with an $EC_{50}$ of 0.1 to 10 nM or less as measured by FACS.
5. The antibody, or antigen binding portion thereof, of any one of the preceding embodiments, wherein the antibody binds to cynomolgus CD73 with an $EC_{50}$ of 0.1 to 10 nM or less as measured by FACS.
6. The antibody, or antigen binding portion thereof, of any one of the preceding embodiments, wherein the antibody binds to an epitope on human CD73 (SEQ ID NO: 1) which includes amino acid residues FTKVQQIRRAEPNVLLLDA (SEQ ID NO: 96) and/or LYLPYKVLPVGDEVVG (SEQ ID NO: 97).
7. The antibody, or antigen binding portion thereof, of embodiment 6, wherein the epitope spans or overlaps with amino acid residues FTKVQQIRRAEPNVLLLDA (SEQ ID NO: 96) and/or LYLPYKVLPVGDEVVG (SEQ ID NO: 97).
8. The antibody, or antigen binding portion thereof, of any one of the preceding embodiments, wherein the antibody is selected from the group consisting of an IgG1, an IgG2, an IgG3, an IgG4 or a variant thereof.
9. An isolated monoclonal antibody, or antigen binding portion thereof, which binds to human CD73 and comprises three heavy chain variable region CDRs and three light chain variable region CDRs that are respectively in the heavy and light chain variable region pairs selected from the group consisting of:
   (a) SEQ ID NOs: 4 and 8
   (b) SEQ ID NOs: 4 and 12;
   (c) SEQ ID NOs: 16 and 20;
   (d) SEQ ID NOs: 16 and 24;
   (e) SEQ ID NOs: 16 and 28;
   (f) SEQ ID NOs: 32 and 36;
   (g) SEQ ID NOs: 40 and 44;
   (h) SEQ ID NOs: 40 and 48;
   (i) SEQ ID NOs: 52 and 56;
   (j) SEQ ID NOs: 60 and 64;
   (k) SEQ ID NOs: 68 and 72;

(l) SEQ ID NOs: 68 and 76;
(m) SEQ ID NOs: 80 and 84;
(n) SEQ ID NOs: 88 and 92;
(o) SEQ ID NOs: 135 and 8; and
(p) SEQ ID NOs: 135 and 12.

10. An isolated monoclonal antibody, or antigen binding portion thereof, which binds to human CD73, comprising:

(a) heavy chain CDR1, CDR2, and CDR3 sequences comprising SEQ ID NOs: 5, 6, and 7, respectively, and/or light chain CDR1, CDR2, and CDR3 sequences comprising SEQ ID NOs: 9, 10, and 11, respectively;

(b) heavy chain CDR1, CDR2, and CDR3 sequences comprising SEQ ID NOs: 5, 6, and 7, respectively, and/or light chain CDR1, CDR2, and CDR3 sequences comprising SEQ ID NOs: 13, 14, and 15, respectively;

(c) heavy chain CDR1, CDR2, and CDR3 sequences comprising SEQ ID NOs: 17, 18, and 19, respectively, and/or light chain CDR1, CDR2, and CDR3 sequences comprising SEQ ID NOs: 21, 22, and 23, respectively;

(d) heavy chain CDR1, CDR2, and CDR3 sequences comprising SEQ ID NOs: 17, 18, and 19, respectively, and/or light chain CDR1, CDR2, and CDR3 sequences comprising SEQ ID NOs: 25, 26, and 27, respectively;

(e) heavy chain CDR1, CDR2, and CDR3 sequences comprising SEQ ID NOs: 17, 18, and 19, respectively, and/or light chain CDR1, CDR2, and CDR3 sequences comprising SEQ ID NOs: 29, 30, and 31, respectively;

(f) heavy chain CDR1, CDR2, and CDR3 sequences comprising SEQ ID NOs: 33, 34, and 35, respectively, and/or light chain CDR1, CDR2, and CDR3 sequences comprising SEQ ID NOs: 37, 38, and 39, respectively;

(g) heavy chain CDR1, CDR2, and CDR3 sequences comprising SEQ ID NOs: 41, 42, and 43, respectively, and/or light chain CDR1, CDR2, and CDR3 sequences comprising SEQ ID NOs: 45, 46, and 47, respectively;

(h) heavy chain CDR1, CDR2, and CDR3 sequences comprising SEQ ID NOs: 41, 42, and 43, respectively, and/or light chain CDR1, CDR2, and CDR3 sequences comprising SEQ ID NOs: 49, 50, and 51, respectively;

(i) heavy chain CDR1, CDR2, and CDR3 sequences comprising SEQ ID NOs: 53, 54, and 55, respectively, and/or light chain CDR1, CDR2, and CDR3 sequences comprising SEQ ID NOs: 57, 58, and 59, respectively;

(j) heavy chain CDR1, CDR2, and CDR3 sequences comprising SEQ ID NOs: 61, 62, and 63, respectively, and/or light chain CDR1, CDR2, and CDR3 sequences comprising SEQ ID NOs: 65, 66, and 67, respectively;

(k) heavy chain CDR1, CDR2, and CDR3 sequences comprising SEQ ID NOs: 69, 70, and 71, respectively, and/or light chain CDR1, CDR2, and CDR3 sequences comprising SEQ ID NOs: 73, 74, and 75, respectively;

(l) heavy chain CDR1, CDR2, and CDR3 sequences comprising SEQ ID NOs: 69, 70, and 71, respectively, and/or light chain CDR1, CDR2, and CDR3 sequences comprising SEQ ID NOs: 77, 78, and 79, respectively;

(m) heavy chain CDR1, CDR2, and CDR3 sequences comprising SEQ ID NOs: 81, 82, and 83, respectively, and/or light chain CDR1, CDR2, and CDR3 sequences comprising SEQ ID NOs: 85, 86, and 87, respectively; or (n) heavy chain CDR1, CDR2, and CDR3 sequences comprising SEQ ID NOs: 89, 90, and 91, respectively, and/or light chain CDR1, CDR2, and CDR3 sequences comprising SEQ ID NOs: 93, 94, and 95, respectively.

11. The antibody, or antigen binding portion thereof, of embodiment 10, wherein the antibody comprises heavy chain CDR1, CDR2, and CDR3 sequences comprising SEQ ID NOs: 5, 6, and 7, respectively, and/or light chain CDR1, CDR2, and CDR3 sequences comprising SEQ ID NOs: 9, 10, and 11, respectively.

12. The antibody, or antigen binding portion thereof, of embodiment 11, wherein the antibody comprises heavy chain CDR1, CDR2, and CDR3 sequences comprising SEQ ID NOs: 5, 6, and 7, respectively, and/or light chain CDR1, CDR2, and CDR3 sequences comprising SEQ ID NOs: 13, 14, and 15, respectively.

13. An isolated monoclonal antibody, or antigen binding portion thereof, which binds to human CD73 and comprises heavy and light chain variable regions, wherein the heavy chain variable region comprises an amino acid sequence which is at least 90% identical to the amino acid sequence selected from the group consisting of SEQ ID NOs: 4, 16, 32, 40, 52, 60, 68, 80, 88, and 135.

14. An isolated monoclonal antibody, or antigen binding portion thereof, which binds to human CD73 and comprises heavy and light chain variable regions, wherein the light chain variable region comprises an amino acid sequence which is at least 90% identical to the amino acid sequence selected from the group consisting of SEQ ID NOs: 8, 12, 20, 24, 28, 36, 44, 48, 56, 64, 72, 76, 84, and 92.

15. An isolated monoclonal antibody, or antigen binding portion thereof, which binds to human CD73 and comprises heavy and light chain variable regions which are at least 85% identical to the heavy and light chain variable region amino acid sequences, respectively selected from the group consisting of:

(a) SEQ ID NOs: 4 and 8
(b) SEQ ID NOs: 4 and 12;
(c) SEQ ID NOs: 16 and 20;
(d) SEQ ID NOs: 16 and 24;
(e) SEQ ID NOs: 16 and 28;
(f) SEQ ID NOs: 32 and 36;
(g) SEQ ID NOs: 40 and 44;
(h) SEQ ID NOs: 40 and 48;
(i) SEQ ID NOs: 52 and 56;
(j) SEQ ID NOs: 60 and 64;
(k) SEQ ID NOs: 68 and 72;
(l) SEQ ID NOs: 68 and 76;
(m) SEQ ID NOs: 80 and 84;
(n) SEQ ID NOs: 88 and 92;
(o) SEQ ID NOs: 135 and 8; and
(p) SEQ ID NOs: 135 and 12.

16. The antibody, or antigen binding portion thereof, of embodiment 15, wherein the heavy and light chain variable regions comprise an amino acid sequence at least 90% identical to the heavy and light chain variable regions, respectively, selected from the group consisting of (a)-(p)

17. The antibody, or antigen binding portion thereof, of embodiment 16, wherein the heavy and light chain variable regions comprise an amino acid sequence at least 95% identical to the heavy and light chain variable regions, respectively, selected from the group consisting of (a)-(p)

18. The antibody, or antigen binding portion thereof, of embodiment 17, wherein the heavy and light chain variable regions comprise the heavy and light chain variable regions, respectively, selected from the group consisting of (a)-(p).

19. The antibody, or antigen binding portion thereof, of embodiment 18, wherein the antibody comprises a heavy chain variable region comprising the amino acid sequence set forth in SEQ ID NO: 135 and a light chain variable region comprising the amino acid sequence set forth in SEQ ID NO: 8.

20. The antibody, or antigen binding portion thereof, of embodiment 18, wherein the antibody comprises a heavy chain variable region comprising the amino acid sequence set forth in SEQ ID NO: 135 and a light chain variable region comprising the amino acid sequence set forth in SEQ ID NO: 12.

21. An isolated monoclonal antibody, or antigen binding portion thereof, which binds to the same epitope on CD73 as the antibody of any one of embodiments 1-20.

22. The antibody, or antigen binding portion thereof, of any one of embodiments 9-21, wherein the antibody exhibits any one of the following properties:
 (1) binding to soluble human CD73, e.g., with a $K_D$ of 10 nM or less (e.g., 0.01 nM to 10 nM), e.g., as measured by BIACORE® SPR analysis;
 (2) binding to membrane bound human CD73, e.g., with an $EC_{50}$ of 1 nM or less (e.g., 0.01 nM to 1 nM);
 (3) binding to cynomolgus CD73, e.g., bind to membrane bound cynomolgus CD73, e.g, with an $EC_{50}$ of 10 nM or less (e.g., 0.01 nM to 10 nM);
 (4) inhibition of human CD73 enzymatic activity, e.g., with an EC50 of 10 nM or less;
 (5) inhibition of cyno CD73 enzymatic activity, e.g., with an EC50 of 10 nM or less;
 (6) inhibition of human CD73 enzymatic activity in vivo; inducing or enhancing T cell activation without requiring multivalent cross-linking;
 (7); internalization into cells, e.g., with a $T_{1/2}$ of less than 10 minutes;
 (8) binding to a conformational epitope on human CD73, e.g., a discontinuous epitope within the amino acid sequence (SEQ ID NO: 1) which includes amino acid residues FTKVQQIRRAEPNVLLLDA (SEQ ID NO: 96) and/or LYLPYKVLPVGDEVVG (SEQ ID NO: 97)
 (9) binding to glycosylated but not unglycosylated human CD73; and
 (10) competing in either direction or both directions for binding to human CD73 with CD73.4-1, CD73.4-2, CD73.3, 11F11-1, 11F11-2, 4C3-1, 4C3-2, 4C3-3, 4D4, 10D2-1, 10D2-2, 11A6, 24H2, 5F8-1, 5F8-2, 6E11 and/or 7A11.

23. An isolated monoclonal antibody, or antigen binding portion thereof, which binds to CD73 and comprises heavy chain and light chain sequences which are at least 80%, 85%, 90%, 95%, 96%, 97%, 98% or 99% identical to the amino acid sequences of the heavy and light chain sequences, respectively, selected from the group consisting of:
 (a) SEQ ID NOs: 100 and 101, respectively;
 (b) SEQ ID NOs: 100 and 102, respectively;
 (c) SEQ ID NOs: 103 and 104, respectively;
 (d) SEQ ID NOs: 103 and 105, respectively;
 (e) SEQ ID NOs: 103 and 106, respectively;
 (f) SEQ ID NOs: 107 and 108, respectively;
 (g) SEQ ID NOs: 109 and 110, respectively;
 (h) SEQ ID NOs: 109 and 111, respectively;
 (i) SEQ ID NOs: 112 and 113, respectively;
 (j) SEQ ID NOs: 114 and 115, respectively;
 (k) SEQ ID NOs: 116 and 117, respectively;
 (l) SEQ ID NOs: 116 and 118, respectively;
 (m) SEQ ID NOs: 119 and 120, respectively;
 (n) SEQ ID NOs: 121 and 122, respectively;
 (o) SEQ ID NOs: 133 and 101, respectively; and
 (p) SEQ ID NOs: 133 and 102, respectively;

24. The antibody, or antigen binding portion thereof, of embodiment 23, wherein the heavy and light chains comprise the heavy and light chains selected from the group consisting of (a)-(p).

25. The antibody, or antigen binding portion thereof, of embodiment 24, wherein the antibody comprises a heavy chain comprising the amino acid sequence set forth in SEQ ID NO: 135 and a light chain comprising the amino acid sequence set forth in SEQ ID NO: 101.

26. The antibody, or antigen binding portion thereof, of embodiment 24, wherein the antibody comprises a heavy chain comprising the amino acid sequence set forth in SEQ ID NO: 135 and a light chain comprising the amino acid sequence set forth in SEQ ID NO: 102.

27. The antibody, or antigen binding portion thereof, of any one of embodiments 23-26, wherein the antibody exhibits any one of the following properties:
 (a) inhibits CD73 enzymatic activity;
 (b) internalizes into tumor cells or
 (c) binds to a conformation epitope comprising amino acids 65-83 and 157-172 of human CD73.

28. The antibody, or antigen binding portion thereof, of any one of the preceding embodiments, wherein the antibody binds to cynomolgus CD73.

29. The antibody, or antigen binding portion thereof, of embodiments 10-22, wherein the antibody comprises an effectorless Fc.

30. The antibody, or antigen binding portion thereof, of embodiments 1-7 and 9-22, wherein the antibody comprises a modified heavy chain constant region, comprising a human CH1 domain, a human hinge domain, a human CH2 domain, and a human CH3 domain in order from N- to C-terminus.

31. The antibody, or antigen binding portion thereof, of embodiment 30, wherein the modified constant region comprises at least 2 domains of different isotypes selected from the group of isotypes consisting of IgG1, IgG2, IgG3, and IgG4.

32. The antibody, or antigen binding portion thereof, of embodiment 30 or 31, wherein the modified constant region comprises a human IgG2 CH1 domain and at least one of the CH2, CH3, and hinge domains is not an IgG2 isotype.

33. The antibody, or antigen binding portion thereof, of embodiment 32, wherein the IgG2 CH1 domain comprises the amino acid sequence ASTKGPSVFPLAPCSRSTSESTAALGCLVKDYFPEPVTVSWNSGALTSGVHTFPAVLQSS GLYSLSSVVTVPSSNFGTQTYTCNVDHKPSNTKVDKTV (SEQ ID NO: 124).

34. The antibody, or antigen binding portion thereof, of any one of embodiments 30-33, wherein the modified constant region comprises a human IgG2 hinge domain which reduces heterogeneity in the cysteine binding.

35. The antibody, or antigen binding portion thereof, of embodiment 34, wherein the hinge domain comprises amino acid substitution C219, relative to a wildtype human IgG2 hinge domain (SEQ NO 136).

36. The antibody, or antigen binding portion thereof, of embodiment 35 wherein the hinge domain comprises the amino acid sequence ERKSCVECPPCPAPPVAG (SEQ ID NO: 123).

37. The antibody, or antigen binding portion thereof, of any one of embodiments 30-36, wherein the modified constant region comprises a human IgG1 CH2 domain which reduces or eliminates effector functions.

38. The antibody, or antigen binding portion thereof, of embodiment 37, wherein the CH2 domain comprises amino acid substitutions A330S and P331S, relative to a wildtype human IgG1 CH2 domain (SEQ ID NO: 137).

39. The antibody, or antigen binding portion thereof, of embodiment 38, wherein the CH2 domain comprises the amino acid sequence APPVAGPSVFLFPPKPKDTLMIS-RTPEVTCVVVDVSHEDPEVKFNWYVDGVEVH-NAKT KPREEQYNSTYRVVSVLTVLHQDWLNG-KEYKCKVSNKALPSSIEKTISKAK (SEQ ID NO: 125).

40. The antibody, or antigen binding portion thereof, of any one of embodiments 30-39, wherein the modified constant region comprises a human IgG1 CH3 domain.

41. The antibody, or antigen binding portion thereof, of embodiment 40, wherein the CH3 domain comprises the amino acid sequence GQPREPQVYTLPPSREEMTKN-QVSLTCLVKGFYPSDIAVEWESNGQPENNYKTTP-PVLD SDGSFFLYSKLTVDKSRWQQGNVFSCSVM-HEALHNHYTQKSLSLSPGK (SEQ ID NO: 128).

42. The antibody, or antigen binding portion thereof, of any one of embodiments 9-29, wherein the antibody, or antigen binding portion thereof, is a human or humanized antibody.

43. The antibody, or antigen binding portion thereof, of embodiments 1-8, wherein methionine residues in the CDR regions are replaced with amino acid residues that do not undergo oxidation.

44. A bispecific molecule comprising the antibody of any one of the preceding embodiments linked to a molecule having a second binding specificity.

45. An immunoconjugate comprising the antibody according to any one of embodiments 1-43, linked to a second different agent.

46. An isolated nucleic acid molecule encoding the heavy and/or light chain variable region of the antibody, or antigen binding portion thereof, of any one of embodiments 1-43.

47. An expression vector comprising the nucleic acid molecule of embodiment 46.

48. A cell transformed with an expression vector of embodiment 47.

49. A composition comprising the antibody, or antigen binding portion thereof, bispecific molecule or immunoconjugate, of any one of embodiments 1-45, and a carrier.

50. A kit comprising the antibody, or antigen binding portion thereof, or bispecific molecule, or immunoconjugate of any one of embodiments 1-45, and instructions for use.

51. A method of preparing an anti-CD73 antibody, or antigen binding portion thereof, comprising expressing the antibody, or antigen binding portion thereof, in the cell of embodiment 48 and isolating the antibody, or antigen binding portion thereof, from the cell.

52. A method of decreasing adenosine levels in a tumor cell expressing CD73, comprising contacting the cell with the antibody, antigen binding portion thereof, bispecific molecule or immunoconjugate, of any one of embodiments 1-45, such that adenosine levels are decreased.

53. A method of stimulating a T cell response against a tumor cell expressing CD73 in a subject in need thereof, comprising administering an effective amount of an antibody, or antigen binding portion thereof, bispecific molecule or immunoconjugate, of any one of embodiments 1-45, such that a T cell response is stimulated against the tumor cell.

54. A method of stimulating an immune response in a subject comprising administering the antibody, or antigen binding portion thereof, bispecific molecule or immunoconjugate, of any one of embodiments 1-45 to the subject, such that an immune response in the subject is stimulated.

55. The method of embodiment 54, wherein the subject has a tumor cell expressing CD73 and an immune response against the tumor cell is stimulated.

56. A method for inhibiting the growth of tumor cells expressing CD73 in a subject comprising administering to the subject the antibody, or antigen binding portion thereof, bispecific molecule or immunoconjugate, of any one of embodiments 1-45, such that growth of the tumor is inhibited in the subject.

57. A method of treating cancer comprising administering to a subject in need thereof a therapeutically effective amount of the antibody, or antigen binding portion thereof, bispecific molecule or immunoconjugate, of any one of embodiments 1-45, to treat the cancer.

58. The method of embodiment 57, wherein the cancer is selected from the group consisting of: bladder cancer, breast cancer, uterine/cervical cancer, ovarian cancer, prostate cancer, testicular cancer, esophageal cancer, gastrointestinal cancer, pancreatic cancer, colorectal cancer, colon cancer, kidney cancer, head and neck cancer, lung cancer, stomach cancer, germ cell cancer, bone cancer, liver cancer, thyroid cancer, skin cancer, neoplasm of the central nervous system, lymphoma, leukemia, myeloma, sarcoma, and virus-related cancer.

59. The method of embodiment 57 or 58, wherein the cancer is a metastatic cancer, refractory cancer, or recurrent cancer.

60. The method of any one of embodiments 53-59, further comprising administering one or more additional therapeutic agents.

61. The method of embodiment 60, wherein the additional therapeutic agent is an immunopotentiating molecule (e.g., a PD-1 antagonist, CTLA-4 antagonist, LAG-3 antagonist), an anti-CD39 antibody or anti-A2AR antibody.

62. A method of detecting the presence of human CD73 in a sample comprising contacting the sample with the antibody, or antigen binding portion thereof, of any one of embodiments 1-45, under conditions that allow for formation of a complex between the antibody, or antigen binding portion thereof, and CD73, and detecting the formation of a complex.

The present disclosure is further illustrated by the following examples, which should not be construed as further limiting. The contents of all figures and all references, Genbank sequences, patents and published patent applications cited throughout this application are expressly incorporated herein by reference. In particular, the disclosures of PCT publications WO 09/045957, WO 09/073533, WO 09/073546, WO 09/054863 and PCT/US2013/072918, and U.S. Patent Publication No. 2011/0150892 are expressly incorporated herein by reference.

EXAMPLES

Example 1

Generation of Human Anti-CD73 Antibodies

Human anti-human CD73 monoclonal antibodies were generated in Hco7, Hco27, Hco20, Hco12, Hco17, and Hc2 strains of HuMAb® transgenic mice ("HuMAb" is a Trade Mark of Medarex, Inc., Princeton, N.J.) and KM mice (the KM Mouse® strain contains the SC20 transchromosome as described in PCT Publication WO 02/43478). HC2/KCo27 HuMAb mice and KM mice were generated as described in U.S. Pat. Nos. 5,770,429 and 5,545,806, the entire disclosures of which are hereby incorporated by reference.

Mice, including various genotypes of transgenic mice (such as, KM, Hco7, Hco27, Hco20, Hco12, Hco17 and Hc2), were immunized with different immunization strategies (different antigen, different dose, duration, routes of administration (footpad (fp), intraperitoneal (ip) and subcutaneous (sc) and adjuvant (CFA/IFA, Ribi and antibody), etc). Fusions from the mice were performed and screened, and antibodies were identified from these fusions. Further characterization led to the isolation of antibodies of particular interest, including the antibodies designated as 11F11-1, 11F11-2, 4C3-1, 4C3-2, 4C3-3, 4D4-1, 10D2-1, 10D2-2, 11A6-1, 24H2-1, 5F8-1, 5F8-2, 6E11-1, and 7A11-1. Table 7 (below) provides the IgG isotype and allotype of the heavy chains, as well as the type of light chain, for each antibody. Antibodies that differ only in the light chain are represented by a different digit after the dash. For example, 11F11-1 has the same heavy chain as 11F11-2, but 11F11-1 has the light chain VK1, whereas 11F11-2 has the light chain VK2. Unless specified otherwise, recombinant antibodies based on VH regions of the antibodies in the table were made with the predominant light chain.

TABLE 7

| Clone | Isotype | Predominant Light Chain | Other Expressed Light Chains |
|---|---|---|---|
| 11F11 | IgG2 | VK2 | VK1 |
| 4C3 | IgG1za | VK1 | VK2, VK3 |
| 4D4 | IgG2 | VK1 | |
| 10D2 | IgG4 | VK2 | VK1 |
| 11A6 | IgG1za | VK1 | |
| 24H2 | IgG4 | VK1 | |
| 5F8 | IgG1za | VK1 | VK2 |
| 6E11 | IgG1za | VK1 | |
| 7A11 | IgG1za | VK1 | |

The amino acid and nucleotide sequences of the full length sequence of the heavy and light chains, the VH and VL domains and the CDRs of each antibody are provided in the Sequence Listing and in Table 35. The VH and VL amino acid sequences are also provided in FIGS. 1A through 17B, and an alignment of the VH and VL amino acid sequences of the various antibodies is provided in FIG. 35 (CDR sequences are in bold).

Example 2

Amino Acid Substitutions in Variable Regions and Isotype Variations

The framework region of the VH region of antibody 11F11 was mutated by introducing one of more of the mutation at the following amino acid residues (surrounding amino acids are shown and the mutated amino acid is underlined): T25 (framework mutation; . . . RLSCA TSGFTF . . . ), L52 (CDR2 mutation; . . . WVAVILY DGSN . . . ), G54 (CDR2 mutation; . . . VILYDG SNKYY . . . ) and V94 (framework mutation; . . . AEDTA VYYCAR . . . ). The names of the constructs and the substitutions in each of them are set forth in Table 8:

TABLE 8

| Ab Name | Originating Ab | Substitution |
|---|---|---|
| CD73.3 | 4C3 | V94A |
| CD73.4 | 11F11 | T25A |
| CD73.5 | | T25S |
| CD73.6 | | T25A, G54S |
| CD73.7 | | T25S, G54S |
| CD73.8 | | T25A, L52W, G54S |
| CD73.9 | | T25S, L52W, G54S |
| CD73.10 | | T25A, L52W, G54E |
| CD73.11* | 4D4 | A25, W52, E54 |

*CD73.11 is 4D4 and contained these amino acid residues as isolated. It is listed in the Table for comparative purposes.

The constant region of antibodies 11F11 and 4D4 was also modified, by switching it to an IgG2 constant region (CH1, hinge, CH2 and CH3) with a C219S substitution ("IgG2CS"; SEQ ID NO:267), an effectorless IgG1 constant region with the substitutions L234A, L235E, G237A, A330S and P331S ("IgG1.1f"; SEQ ID NO:268) or an effectorless IgG1/IgG2 hybrid constant region that contains a CH1 and hinge from IgG2 (with C219S) and CH2 and CH3 of IgG1 (with A330S/P331S) ("IgG2CS-IgG1.1f" or "IgG2C219S-IgG1.1f"; SEQ ID NO:169). The constructs that were made are listed in Table 9.

TABLE 9

| Ab Name | Originating Ab | VH substitution | Constant region | Name of Ab |
|---|---|---|---|---|
| CD73.4 | 11F11 | T25A | IgG2CS | CD73.4-IgG2CS |
| CD73.4 | | T25A | IgG2CS-IgG1.1f | CD73.4-IgG2CS IgG1.1f |
| CD73.6 | | T25A, G54S | IgG2CS-IgG1.1f | CD73.6-IgG2CS IgG1.1f |
| CD73.8 | | T25A, L52W, G54S | IgG2CS-IgG1.1f | CD73.8-IgG2CS IgG1.1f |
| CD73.10 | | T25A, L52W, G54E | IgG2CS-IgG1.1f | CD73.10-IgG2CS IgG1.1f |
| CD73.10 | | T25A, L52W, G54E | IgG1.1f | CD73.10-IgG1.1f |
| CD73.10 | | T25A, L52W, G54E | IgG2CS | CD73.10-IgG2CS |
| CD73.11 | 4D4 | A25, W52, E54 | IgG2CS | CD73.11-IgG2CS |

The amino acid sequence of CD73.4-IgG2CS IgG1.1f is shown in FIG. 18 (SEQ ID NO: 189).

Abs CD73.3-CD73.11 were made as follows. Light chain VK2 (SEQ ID NO: 102) was used for the antibodies deriving from 11F11 (CD73.4, CD73.6, CD73.8 and CD73.10). The heavy and light chains were expressed in HEK293-6E cells and culture media were harvested 5 days after transfection.

Binding of the constructs to human FcγRs was measured via SPR. hCD64 and hCD32a-H131 binding data for IgG1.1 and IgG2 molecules were consistent with expected values for the different Fcs. IgG1.1f is the most inert Fc. IgG2 and IgG2-C219S showed typical FcR binding for IgG2. As expected, data for IgG2-C219S-G1.1f suggests significantly weaker binding than wild type IgG1 or IgG2, but increased binding compared to IgG1.1f. IgG2-C219S-G1.1f had weak hCD32a-H131 binding ($K_D$ of 2.3 µM) and the binding affinity to all other FcγRs were less than 5 µM. Binding affinity of IgG2-C219S-G1.1f to cyno FcγRs was more than 5 µM. SPR analysis of binding IgG2-C219S-G1.1f to human FcRn showed pH-dependent binding (strong at pH6, and weak binding with fast dissociation at pH 7.4).

The recombinant preparations were found to frequently lack the C-terminal Lys of the heavy chain. For example, 97% of the heavy chains of Ab CD73.4.IgG2-C219S-G1.1f lacked the C-terminal lysine. Certain preparations had pyro-Q at the N-terminal Q (glutamine) of the heavy chain. For example, 94% of the N-terminal glutamine of the heavy chain of Ab CD73.4.IgG2-C219S-G1.1f was pyro-Q.

Example 3

Binding Characteristics of Anti-CD73 Antibodies

A. Surface Plasmon Resonance (SPR)

CD73 binding kinetics and affinity were studied by surface Plasmon Resonance (SPR) using a Biacore T100® instrument (GE Healthcare®) at 25° C.

One experimental format tested the binding of the N-terminal domain of hCD73 (consisting of residues 26-336 of human CD73; termed N-hCD73) to antibodies that were captured on immobilized protein A surfaces. For these experiments, protein A (Pierce®) was immobilized to a density of 3000-4000 RU on flow cells 1-4 of a CM5 sensor chip (GE Healthcare) using standard ethyl(dimethylaminopropyl) carbodiimide (EDC)/N-hydroxysuccinimide (NHS) chemistry, with ethanolamine blocking, in a running buffer of 0.01 M HEPES pH 7.4, 0.15 M NaCl, 3 mM EDTA, 0.005% v/v TWEEN 20®. Kinetic experiments were performed by first capturing antibodies (5-10 µg/ml) on the protein A surfaces using a 30 s contact time at 10 µl/min, with binding of 600, 200, 66.7, 22.2, 7.4, and 2.5 nM N-hCD73-his, using a 180 s association time and 360 s dissociation time at a flow rate of 30 µl/min. The running buffer for the kinetic experiments was 10 mM sodium phosphate, 130 mM sodium chloride, 0.05% tween 20, pH 7.1. The surfaces were regenerated after each cycle using two 30 s pulses of 10 mM glycine pH 1.5 at a flow rate of 30 Sensogram data was double-referenced and then fitted to a 1:1 Langmuir model using Biacore T100 evaluation software v2.0.4, to determine the association rate constant (ka), the dissociation rate constant (kd), and the equilibrium dissociation constant (KD).

The results are shown in Table 10. The table compiles data from different experiments. For antibodies for which two or more sets of numbers are shown, each set corresponds to data obtained in a separate experiment.

TABLE 10

Kinetics of CD73 mAbs binding to N-hCD73-his (hCD73(26-336)His) at 25 C. °

| mAb | Fc | ka (1/Ms) | kd (1/s) | KD (nM) |
|---|---|---|---|---|
| 11F11 | IgG2 | 2.6E+05 | 4.2E−04 | 1.6 |
|  |  | 2.9E+05 | 1.6E−04 | 0.56 |
| 4C3 | IgG1 | 2.2E+04 | 2.4E−03 | 110 |
|  |  | 2.4E+04 | 2.2E−03 | 92 |
| 4D4 | IgG2 | 8.2E+04 | 7.7E−04 | 9.4 |
|  |  | 7.9E+04 | 4.9E−04 | 6.2 |
| 10D2 | IgG4 | 6.1E+05 | 9.5E−04 | 1.6 |
| 11A6 | IgG1 | 5.5E+04 | 7.6E−03 | 140 |
| 1H9 | IgG1 | 3.3E+05 | 9.3E−04 | 2.8 |
| 24H2 | IgG4 | 2.3E+05 | 3.2E−03 | 14 |
| 5F8 | IgG1 | 1.5E+05 | 6.0E−03 | 41 |
| 6E11 | IgG1 | 5.7E+04 | 1.4E−03 | 25 |
| 7A11 | IgG1 | 8.8E+05 | 3.8E−04 | 0.43 |
| CD73.4 | IgG1.1f | 4.2E+05 | 3.9E−04 | 0.92 |
| CD73.4 | IgG2-C219S | 2.9E+05 | 1.6E−04 | 0.55 |
|  |  | 2.8E+05 | 3.3E−04 | 1.2 |
|  |  | 2.9E+05 | 3.7E−04 | 1.3 |
|  |  | 3.5E+05 | 4.4E−04 | 1.2 |
| CD73.4 | IgG2-C219S-IgG1.1f | 3.1E+05 | 3.5E−04 | 1.1 |
|  |  | 3.3E+05 | 1.4E−04 | 0.43 |
|  |  | 3.1E+05 | 1.3E−04 | 0.42 |

TABLE 10-continued

Kinetics of CD73 mAbs binding to N-hCD73-his (hCD73(26-336)His) at 25 C. °

| mAb | Fc | ka (1/Ms) | kd (1/s) | KD (nM) |
|---|---|---|---|---|
|  |  | 3.2E+05 | 1.5E−04 | 0.47 |
|  |  | 3.1E+05 | 4.1E−04 | 1.4 |
|  |  | 2.7E+05 | 3.8E−04 | 1.4 |
|  |  | 3.0E+05 | 4.1E−04 | 1.4 |
|  |  | 3.1E+05 | 4.2E−04 | 1.3 |
|  |  | 3.2E+05 | 4.3E−04 | 1.3 |
|  |  | 2.9E+05 | 4.0E−04 | 1.4 |
| CD73.10 | IgG1.1f | 2.7E+05 | 1.3E−03 | 4.7 |
| CD73.10 | IgG2-C219S | 2.2E+05 | 1.4E−03 | 6.2 |
|  |  | 2.2E+05 | 1.8E−03 | 8.3 |
| CD73.10 | IgG2-C219S-IgG1.1f | 2.4E+05 | 1.4E−03 | 5.7 |
|  |  | 2.3E+05 | 1.60E−03 | 6.8 |
| CD73.3 | IgG1.1f | 1.6E+04 | 3.6E−03 | 220 |
| CD73.11 | IgG2-C219S | 8.0E+04 | 2.8E−04 | 3.5 |
|  |  | 7.9E+04 | 5.1E−04 | 6.5 |
| CD73.6 | IgG1.1f | 3.7E+05 | 2.5E−04 | 0.68 |
| CD73.6 | IgG2-C219S-IgG1.1f | 3.0E+05 | 2.2E−04 | 0.72 |

The $K_D$ in the table is the monovalent $K_D$, i.e., $K_D$ of binding of the antibodies to the N-terminal portion of human CD73, which is monovalent.

The G54S mutation is tolerated and appears to slightly increase affinity, while removing the predicted DG isomerization site. The L52W mutation appears to cause a decrease in affinity of approximately 10 fold. The 4D4 variants have unique CDR3 sequences and different kinetics (slower association compared to 11F11 molecules).

The average $K_D$ from 10 experiments for CD73.4-IgG2-C219S-IgG1.1f is 1.1±0.4 nM. The T25A mutation relative to 11F11 does not impact the affinity.

The results show that all anti-CD73 antibodies bind to human CD73 with good affinity and have a slow dissociation rate.

The results of the binding studies indicate that binding activity was maintained following introduction of mutations into 11F11, 4C3 or 4D4, or isotype switch, although some antibodies had reduced affinity relative to the original antibody (i.e., 11F11, 4C3 or 4D4). In particular, CD73.10 (T25A, L52W, G54E) has a faster dissociation rate than CD73.4 (T25A) or CD73.11 (4D4). Comparison of all IgG2 molecules indicates that 11F11 and CD73.4 (11F11-T25A) have the highest monovalent CD73 affinity (KD=1.1 nM±0.4 nM). CD73.10 (11F11-T25A, L52W, G54E) has ~10-fold lower CD73 affinity than 11F11 or CD73.4. This suggests either L52W or G54E or both mutations reduce CD73 affinity when in combination with other 11F11 sequences. 4D4 and CD73.11 have affinity comparable to CD73.10 (KD~5 nM), but different kinetics. 4C3 epitope is believed to include regions of N- and C-domains of CD73, therefore the measured KD for an isolated N-domain is weak (KD=100-200 nM).

Binding of CD73.4-IgG2-C219S-IgG1.1f to cyno CD73 was also investigated. The specificity of CD73.4-IgG2-C219S-IgG1.1f for binding cynomolgus monkey CD73 was compared to that of binding to human CD73 by surface Plasmon resonance (SPR) using a Biacore T100 instrument (GE Healthcare) at 25° C. The full length extracellular domain of either human CD73 (consisting of residues 27-547 of human CD73 linked to a His tag, termed hCD73-his) or cynomolgus CD73 (consisting of residues 27-547 of cynomolgus CD73 linked to a His tag, termed cy-CD73-his) were tested for binding to antibodies that were captured on immobilized protein A surfaces. For these experiments, protein A (Pierce) was immobilized to a density of 3000-

4000 RU on flow cells 1-4 of a CM5 sensor chip (GE Healthcare) using standard ethyl(dimethylaminopropyl) carbodiimide (EDC)/N-hydroxysuccinimide (NHS) chemistry, with ethanolamine blocking, in a running buffer of 0.01 M HEPES pH 7.4, 0.15 M NaCl, 3 mM EDTA, 0.005% v/v tween 20. Experiments were performed by first capturing antibodies (5-10 ug/ml) on the protein A surfaces using a 30 s contact time at 10 ul/min, with binding of 600, 200, 66.7, 22.2, 7.4, and 2.5 nM hCD73-his or cyno-CD73-his, using a 180 s association time and 360 s dissociation time at a flow rate of 30 ul/min. The running buffer for these experiments was 10 mM sodium phosphate, 130 mM sodium chloride, 0.05% tween 20, pH 7.1. The surfaces were regenerated after each cycle using two 30 s pulses of 10 mM glycine pH 1.5 at a flow rate of 30 μl/min.

The results, which are shown in FIG. 19, indicate that CD73.4-IgG2-C219S-IgG1.1f binds with similar affinity and kinetics to cyno and human CD73. CD73.4-IgG2-C219S-IgG1.1f binds to full length human and cyno CD73 dimer with a KD of less than 1 nM. No significant cross-reactivity of CD73.4-IgG2-C219S-IgG1.1f to mouse or rat CD73 was observed.

The kinetics and affinity of an isolated Fab fragment from the 11F11 antibody was also evaluated by SPR. In these experiments, Fab domain from a murine anti-6×His antibody was immobilized on a CM5 sensor chip using EDC/NHS to a density of ~3000 RU. Full-length hCD73-his was captured to 10 RU density on Fc2 (1 ug/ml hCD73-his), 40 RU density on Fc3 (5 ug/ml hCD73-his) and 160 RU density on Fc4 (20 ug/ml hCD73-his), using a 30 s contact time at 10 ul/min. Next, the 11F11 Fab fragment (purified from pepsin-cleaved L-cysteine-reduced 11F11 antibody) was tested for binding at 400, 135, 44.4, 14.8, 4, 9, 1.7, 0.55 nM, using 180 s association time, 600 s dissociation time at 30 ul/min, in a running buffer of 10 mM sodium phosphate, 130 mM sodium chloride, 0.05% tween 20, pH 7.1. The surfaces were regenerated after each cycle using two 15 s pulses of 10 mM glycine pH 2.0 at a flow rate of 30 μl/min. Sensorgram data was double-referenced and then fitted to a 1:1 Langmuir model using Biacore T100 evaluation software v2.0.4, to determine the association rate constant (ka), the dissociation rate constant (kd), and the equilibrium dissociation constant ($K_D$). The results are shown in Table 11 below.

TABLE 11

Kinetics of 11F11-Fab binding to hCD73-his surface at 25 C. °

| hCD73-his surface density (RU) | ka (1/Ms) | kd (1/s) | $K_D$ (nM) |
| --- | --- | --- | --- |
| 10 | 1.2E+06 | 8.7E−04 | 0.73 |
| 40 | 1.2E+06 | 8.7E−04 | 0.73 |
| 160 | 1.1E+06 | 8.5E−04 | 0.77 |

Thus, the results show that the 11F11 Fab fragment has high affinity for hCD73 ($K_D$~0.74 nM).

B. Binding of CD73 Antibodies to CD73 positive cells

Titration binding curves were produced with CD73 antibodies on Calu6 (CD73 endogenous expressors; human pulmonary adenocarcinoma cell line), DMS 114 (CD73 negative; human small cell lung cancer cell line), CHO-cynoCD73 (cynoCD73-transfected) and CHO-K1 (cynoCD73 negative), cells using Alexa Fluor® 647 Goat Anti-Human IgG (H+L) as a secondary antibody, Invitrogen® Cat#A-21445, using the following method:

100000 cells were plated in 100 uL PBS+2% FBS per well and blocked for 20 min. Using a U-bottom 96-deep well plate, volumes of antibody and PBS+2% FBS were combined as dictated by Table 12 below.

TABLE 12

| Clone | [Stock] (mg/mL) | [Stain] (mg/ml) | Vol Ab (uL) | Vol TM (uL) |
| --- | --- | --- | --- | --- |
| 11F11 | 3.70 | 0.020 | 2.92 | 537.1 |
| CD73.10-IgG1.1f | 1.3 | 0.020 | 8.31 | 531.7 |
| CD73.10-IgG2 | 1 | 0.020 | 10.80 | 529.2 |
| CD73.10-IgG2CS-IgG1.1f | 1 | 0.020 | 1-/80 | 529.2 |
| CD73.4-IgG2 | 2.3 | 0.020 | 4.70 | 535.3 |
| CD73.4-IgG2CS-IgG1.1f | 2 | 0.020 | 5.40 | 534.6 |
| CD73.4-IgG1.1f | 2.3 | 0.020 | 4.70 | 535.3 |

An 8-point serial dilution was performed by diluting a sixth of the volume (90 uL) into 450 μL PBS+2% FBS. The cell plate was spun down for 5 minutes at 1500 rpm. 100 uL of diluted antibody was added per well of the plate. 100 uL PBS+2% FBS were added to all other wells. The plates were stained on ice for 45 min, spun down at 1500 rpm for 5 min and washed twice in 200 uL PBS+2% FBS per well. Wells that had received unconjugated antibody, plus one unstained well per cell line, were resuspended in 100 uL APC anti-human secondary antibody (20 ug/mL). 100 uL PBS+2% FBS was added to all other wells, and stained on ice for 45 min. The plates were spun down at 1500 rpm for 5 min and washed in 200 uL PBS+2% FBS per well. The plates were washed again, resuspended in 200 uL 2% FBS in PBS per well and the samples were run.

The results, which are shown in FIGS. 20A1, 20A2, 20B1, 20B2, 20C1, 20C2, 20D1, 20D2, and Table 13, indicate that all the CD73 antibodies bind to cells that naturally express CD73 (Calu6 cells) and CHO cells transfected to express cyno CD73, but that the antibodies do not bind to cells that do not express CD73 (DMS 114 and CHO-K1). The EC50 of binding obtained for each antibody are shown in Table 13.

TABLE 13

| Antibody | EC50 nM Calu6 | EC50 nM CHO-cynoCD73 |
| --- | --- | --- |
| 11F11 | 0.78 | 0.58 |
| CD73.10-IgG1.1f | 0.64 | 0.67 |
| CD73.10-IgG2 | 0.85 | 1.24 |
| CD73.10-IgG2CS-IgG1.1f | 0.85 | 1.27 |
| CD73.4-IgG2 | 0.49 | 0.34 |
| CD73.4-IgG2CS-IgG1.1f | 0.53 | 0.51 |
| CD73.4-IgG1.1f | 0.43 | 0.45 |

The EC50 of binding of CD73.4-IgG2-IgG1.1f to human tumor cell lines was 0.5 nM (range of 0.3 to 0.67 nM). The EC50 of binding of CD73.4-IgG2-IgG1.1f to cyno CD73 transfected CHO cells was 0.3 nM (range 0.1 to 0.5 nM).

Figure 20E:
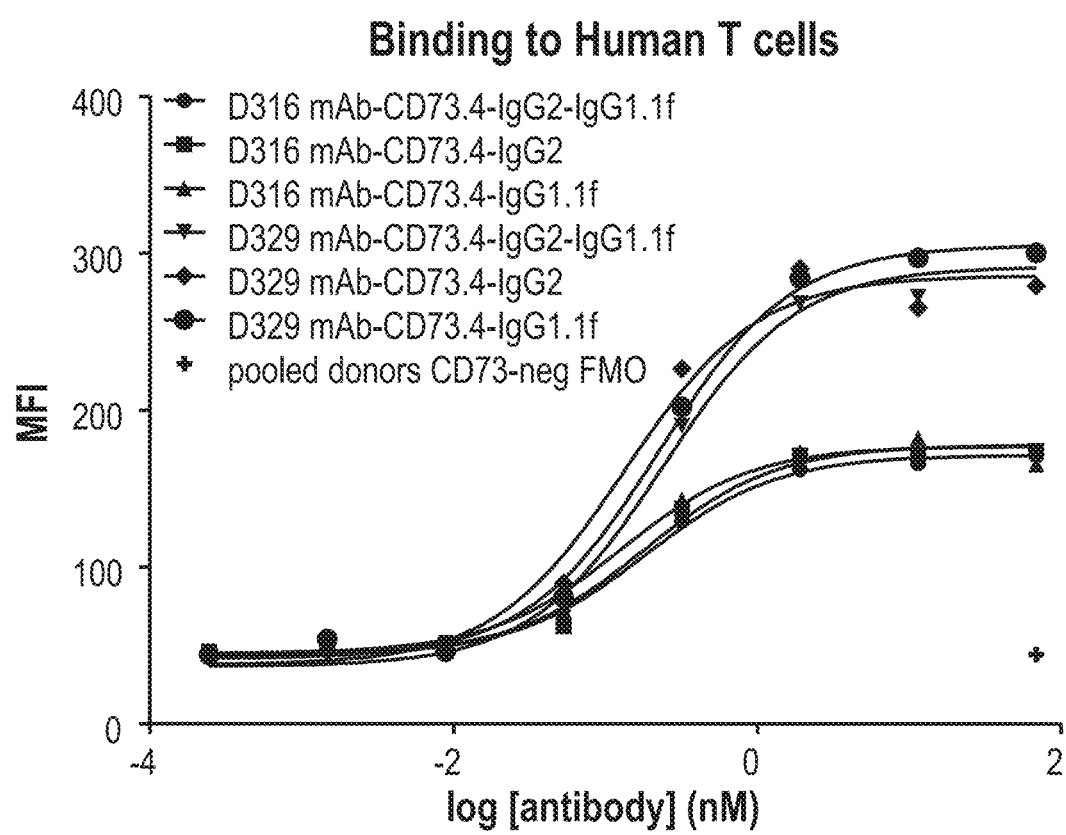
FIG. 20E shows the binding of the indicated antibodies to T cells from donors D1 and D2.
Figure 20F:
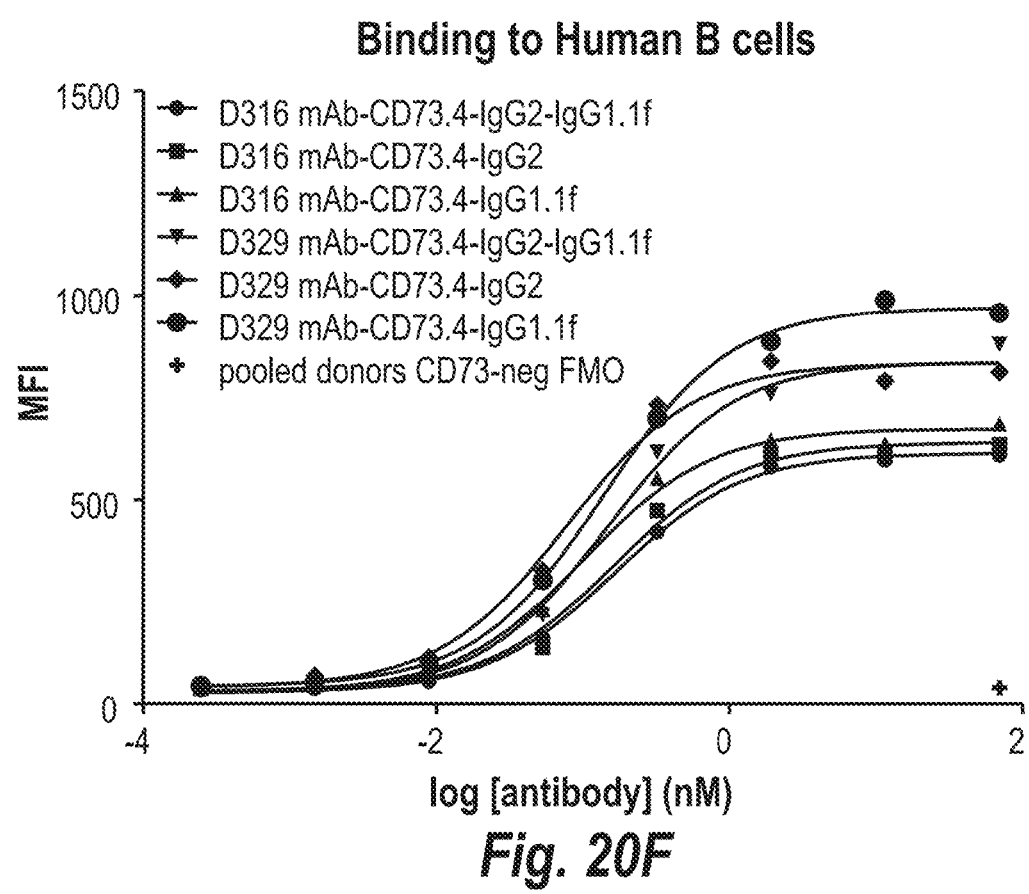
FIG. 20F shows the binding of the indicated antibodies to T cells from donors D1 and D2.

Binding of CD73.4 antibody to human B and T cells was also determined. Human blood from two donors, D316 and D329, was obtained from Immunsciences, BMS. Peripheral blood mononuclear cells (PBMC) were isolated with Lympholyte-H cell separation gradient media. PBMC were incubated with serially diluted FITC-labeled CD73.4-IgG2, CD73.4-IgG2-IgG1.1f, or CD73.4-IgG1.1f antibodies, and T cells and B cells were identified with fluorochrome-labeled antibodies to CD3 and CD20. Cells from both donors were pooled for the unstained and FMO (Fluorescence minus one) control samples. The results, which are shown in FIGS. 20E and F and Table 14, indicate that the antibodies bind specifically to human B and T cells.

TABLE 14

IC50 of binding of CD73 antibodies to B and T cells

|  | IC50 (nM) B cells | IC50 (nM) T cells |
| --- | --- | --- |
| D316 mAb-CD73.4-IgG2CS-IgG1.1f | 0.1648 | 0.1829 |
| D316 mAb-CD73.4-IgG2 | 0.1588 | 0.1799 |
| D316 mAb-CD73.4-IgG1.1f | 0.0994 | 0.1263 |
| D329 mAb-CD73.4-IgG2CS-IgG1.1f | 0.1454 | 0.2406 |
| D329 mAb-CD73.4-IgG2 | 0.07766 | 0.1348 |
| D329 mAb-CD73.4-IgG1.1f | 0.1356 | 0.2248 |

Example 4

Biophysical Characteristics of Anti-CD73 Antibodies

A. Size-Exclusion Chromatography Coupled to an in-Line Multi-Angle Light Scattering Detector (SEC-MALS)

The oligomeric state of CD73 mAbs were examined by size-exclusion chromatography coupled to an in-line multi-angle light scattering detector (SEC-MALS). Isocratic separations were performed on a Shodex® PROTEIN KW-803 column connected to an Prominence Shimadzu® UFLC® in buffer containing 200 mM $K_2HPO_4$, 150 mM NaCl, pH 6.8, containing 0.02% Na azide (0.1 µm filtered) running at 0.5 mL/min. Samples were injected onto the column using a SIL-20AC Prominence Shimadzu® autosampler, and data were obtained from three online detectors connected in series: a Prominence SPD-20AD® diode array UV/vis spectrophotometer followed by a Wyatt miniDAWN™ TREOS Multi-Angle Light Scattering Detector then a Wyatt Optilab T-rEX™Refractive Index Detector. Data (as shown in Table 15 below) were collected and analyzed using Astra (Wyatt) and Labsolutions (Shimadzu) software. The results are shown in Table 15.

B. Differential Scanning Calorimetry (DSC)

The thermal stability of CD73 mAbs were determined using a MicroCal Capillary DSC instrument (GE Healthcare). Antibodies were analyzed at a concentrations of 0.5-0.75 mg/ml in PBS pH 7.1. To stabilize the DSC instrument baseline and obtain a consistent thermal history, multiple scans of buffer alone in both the sample and reference cell were recorded prior to sample analysis. Sample scans contained mAb in the sample cell and PBS pH 7.1 in the reference cell. All scans were run from 10-110° C. at a scan rate of 60°/hr using a 5 minute pre-cycle thermostat period and no post-cycle thermostat period. Data (as shown in Table 15 below) were analyzed using MicroCal Origin Cap DSC analysis software. The appropriate buffer-buffer blank scans were subtracted from the sample-buffer data, and the transition midpoint temperature (Tm) values were determined by fitting the data to a non-2-state model. The results are shown in Table 15. Tm1, Tm2 and Tm3 are the Tms for different domains in the antibodies.

TABLE 15

SEC-MALS and DSC

| mAb | Fc | SEC % HMW | SEC % Monomer | SEC % LMW | MALS Mass (main peak/ monomer) | DSC Tonset (oC) | DSC Tm1 (oC) | DSC Tm2 (oC) | DSC Tm3 (oC) |
| --- | --- | --- | --- | --- | --- | --- | --- | --- | --- |
| 7A11 |  | 0.5 | 98.5 | 0.5 | 146.3 | 56.0 | 64.8 | 70.2 | 82.8 |
| 6E11 |  | 2.1 | 97.6 | 0.1 | 145.2 | 55.0 | 62.3 | 72.0 | 83.3 |
| 11F11 |  | 0.8 | 99.2 | 0.0 | 143.3 | 64.0 | 73.3 | 78.0 |  |
| 5F8 |  | 2.3 | 97.7 | 0.0 | 143.8 | 59.0 | 68.7 | 82.7 |  |
| 4C3 |  | 0.9 | 94.4 | 4.5 | 142.7 | 60.0 | 66.9 | 71.2 | 82.7 |
| 11A6 |  | 4.8 | 94.0 | 0.0 | 143.2 | 61.0 | 66.0 | 71.4 | 82.1 |
| 10D2 |  | 1.1 | 98.8 | 0.0 | 141.4 | 61.0 | 67.7 | 77.1 |  |
| 24H2 |  | 0.0 | 100.0 | 0.0 | 142.4 | 62.0 | 71.7 | 76.9 | 79.8 |
| 4D4 |  | 3.2 | 96.8 | 0.0 | 144.2 | 62.0 | 71.7 | 77.0 | 79.9 |
| CD73.4 | IgG1.1f |  | 98.2 | 1.8 | 140.4 | 59 | 65.5 | 81.2 |  |
| CD73.4 | IgG2-C219S |  |  |  |  | 60 | 72.9 | 77.5 |  |
| CD73.4 | IgG2-C219S-IgG1.1f | 0.4 | 99.6 |  | 141.5 | 59 | 68.4 | 78.3 |  |
| CD73.10 | IgG1.1f | 0.4 | 99.6 |  | 135.9 | 55 | 64.2 | 78.2 |  |
| CD73.10 | IgG2-C219S |  | 100 |  | 152 | 61 | 73.2 | 77.0 |  |
| CD73.10 | IgG2-C219S-IgG1.1f |  | 100 |  | 139.5 | 61 | 70.4 | 76.5 | 84.1 |
| CD73.3 | IgG1.1f | 0.6 | 99.4 |  | 146.1 | 56 | 64.8 | 75.0 | 83.4 |
| CD73.11 | IgG2-C219S |  |  |  |  | 61 | 73.4 | 77.9 |  |
| CD73.6 | IgG1.1f | 0.2 | 99.7 | 0.0 | 142.0 | 58 | 64.2 | 79.7 |  |
| CD73.6 | IgG2-C219S-IgG1.1f | 0.3 | 99.7 | 0.1 | 142.3 | 60 | 70.1 | 77.4 | 84.6 |

The results show that all antibodies are mostly monomeric and are stable.

Example 5

Inhibition of Enzymatic Activity by Anti-CD73 Abs

A. Inhibition of Bead-Bound CD73 Enzymatic Activity

To assess bead-bound CD73 enzyme activity inhibition by anti-CD73 antibodies, the following materials and methods were used:

Materials

TM buffer: 25 mM Tris, 5 mM $MgCl_2$ in water 0.5 mM Sodium Phosphate buffer, pH 8.0

Wash buffer (10 mL 0.5 mM Sodium phosphate, pH 8.0; 10 mL 5M NaCl; 34 mL water; 10 uL Tween-20)

Adenosine 5'-monophosphate disodium salt, Sigma® Cat#01930-% G, 300 mM in TM buffer Adenosine 5'-triphosphate disodium salt hydrate, Sigma Cat#A6419-1G, 100 mM in TM buffer rhCD73, 0.781 mg/mL cyno CD73, Sino Biological Inc® Cat#90192-C08H Magnet his-tag beads, Invitrogen Cat# 10103D CellTiter-Glo® Luminescent Cell Viability Assay, Promega® Cat#G7572 mAbO, an unrelated antibody that does not bind CD73

Methods

A 6-point serial dilution of the anti-CD73 antibodies listed in Table 16 (max concentration 10 ug/mL) was conducted by combining volumes as dictated in Table 16, and diluting 3-fold (transferring 225 uL into 450 uL TM buffer). All antibodies with an IgG2 hinge contained the C219S mutation.

TABLE 16

| Clone | [Stock] (mg/mL) | [Stim] (mg/mL) | Vol Ab (uL) | Vol TM (uL) |
|---|---|---|---|---|
| mAbO | 5.38 | 0.010 | 1.25 | 673.7 |
| F3713.11F11.F3.A4 | 3.70 | 0.010 | 1.82 | 673.2 |
| mAb-CD73.10-Vh-hHC-IgG1.1f | 1.3 | 0.010 | 5.19 | 669.8 |
| mAb-CD73.10-Vh-hHC-IgG2 | 1 | 0.010 | 6.75 | 668.3 |
| mAb-CD73.10-Vh-hHC-IgG2-IgG1.1f | 1 | 0.010 | 6.75 | 668.3 |
| mAb-CD73.4-Vh-hHC-IgG2 | 2.3 | 0.010 | 2.93 | 672.1 |
| mAb-CD73.4-Vh-hHCIgG2-IgG1.1f | 2 | 0.010 | 3.38 | 671.6 |
| mAb-CD73.4-Vh-IgG1.1f | 2.3 | 0.010 | 2.93 | 672.1 |

Magnet beads (2 ul beads per sample) were washed in 1 mL Sodium phosphate buffer in a microcentrifuge tube. The beads were pulled down with the magnet and resuspended in 400 uL TM buffer. For each species of CD73: In a separate tube, CD73 (75 ng per sample) was combined with TM to bring the volume up to 400 uL. A third tube was prepared for blank beads (no CD73). The bead suspension was combined with rhCD73 solution and mixed on a shaker for 5 min at room temperature. The beads were pulled down with a magnet and the beads were washed in 1 mL wash buffer. The beads were pulled down with a magnet and resuspended in TM buffer (40 uL per sample). The beads were transferred to PCR 96-well plates (40 uL per well). 200 uL per well of serially diluted CD73 HuMab were added to plates and mixed well. The plates were incubated for 30 min at room temperature. 700 uL each of 400 uM ATP (8×) and 1.2 mM AMP (8×) were prepared. 650 uL of each were combined to make a 4X AMP/ATP stock mix. The beads were pulled down and washed twice with 200 uL TM buffer per well. The beads were pulled down again and resuspended in 30 uL TM buffer. The 30 uL beads were transferred to 96 well black plates. 10 uL of the 4x stock solution of AMP/ATP (final concentration 150 uM AMP/50 uM ATP) was added and mixed. Control wells (final concentration 150 uM AMP and/or 50 uM ATP) in 40 uL volume were added. The plates were incubated for 15 min at 37° C.

The results are shown in FIGS. 21A1, 21A2, 21B1, and 21B2, and Table 17.

TABLE 17

| mAB | Fc | EC50 (nM) |
|---|---|---|
| 11F11 | IgG2 | 3.98 |
| 4C3 | IgG1 | 3.63 |
| 4D4 | IgG2 | 5.31 |
| 10D2 | IgG1 | 6.94 |
| 11A6 | IgG1 | 3.12 |
| 24H2 | IgG1 | 4.18 |
| 5F8 | IgG1 | 5.76 |
| 6E11 | IgG1 | 3.71 |
| 7A11 | IgG1 | 2.86 |
| CD73.4 | IgG1.1f | 3.25 |
| CD73.4 | IgG2-C219S | 2.72 |
| CD73.4 | IgG2-C219S-IgG1.1f | 2.97 |
| CD73.10 | IgG1.1f | 4.69 |
| CD73.10 | IgG2-C219S | 7.54 |
| CD73.10 | IgG2-C219S-IgG1.1f | 4.84 |

The results of enzymatic inhibition of cyno CD73 are set forth in Table 18.

TABLE 18

| mAB | Fc | EC50 (nM) |
|---|---|---|
| CD73.4 | IgG1.1f | 7.123 |
| CD73.4 | IgG2-C219S | 3.658 |
| CD73.4 | IgG2-C219S-IgG1.1f | 4.572 |
| CD73.10 | IgG1.1f | 10.2 |
| CD73.10 | IgG2-C219S | 8.783 |
| CD73.10 | IgG2-C219S-IgG1.1f | 9.935 |

The results show that the antibodies dose dependently inhibit the enzymatic activity of human CD73. CD73.4.IgG2-C219S-IgG1.1f has an EC50 of 2.97 (range 2.9 to 3.1 nM) in the recombinant human CD73 enzyme inhibition assay. CD73.4.IgG2-C219S-IgG1.1f has an EC50 of 3.7 (range 1.6 to 12.6 nM) in the recombinant cyno CD73 enzyme inhibition assay. Thus, all antibodies to CD73 tested inhibit bead bound human and cyno CD73 enzymatic activity.

B. Inhibition of CD73 Enzymatic Activity in Calu6 Cells

This example describes the assessment of Calu6 (CD73 positive) and DMS-114 (CD73 negative) cells for CD73 dephosphorylation of AMP after treatment with anti-CD73 antibodies.

Materials:

CD73 antibodies; see table below

MabO control antibody, 5.38 mg/mL

TM buffer: 25 mM Tris, 5 mM $MgCl_2$ in water

Adenosine 5'-monophosphate disodium salt, Sigma Cat#01930-5G, 300 mM in TM buffer Adenosine 5'-triphosphate disodium salt hydrate, Sigma Cat#A6419-1G, 100 mM in TM buffer rhCD73, 0.781 mg/mL CellTiter-Glo® Luminescent Cell Viability Assay, Promega Cat#G7572

Methods:

The antibodies were serially diluted by combining volumes of purified antibodies and PBS as dictated by Table 19 below in a U-bottom 96-well plate. 6-point serial dilutions with the antibodies (max concentration 25 ug/mL, 300 uL), and 5-fold dilutions, transferring 60 uL into 240 uL PBS, were performed. All antibodies with an IgG2 hinge contained the C219S mutation.

TABLE 19

| Clone | Conc (mg/mL) | Vol Ab (uL) | Vol PBS (uL) |
|---|---|---|---|
| mAbO | 5.38 | 1.39 | 298.6 |
| F3713.11F11.F3.A4 | 3.70 | 2.03 | 298.0 |
| mAb-CD73.10-Vh-hHC-IgG1.1f | 1.3 | 5.77 | 294.2 |
| mAb-CD73.10-Vh-hHC-IgG2 | 1 | 7.50 | 292.5 |
| mAb-CD73.10-Vh-hHC-IgG2-IgG1.1f | 1 | 7.50 | 292.5 |
| mAb-CD73.4-Vh-hHC-IgG2 | 2.3 | 3.26 | 296.7 |
| mAb-CD73.4-Vh-hHC-IgG2-IgG1.1f | 2 | 3.75 | 296.3 |
| mAb-CD73.4-Vh-hHC-IgG1.1f | 2.3 | 3.26 | 296.7 |

Cells were harvested with Versene and counted. Plates were seeded, spun down at 1500 rpm for 5 min, and resuspended in 100 uL serially diluted antibody. All other wells were resuspended in 100 uL PBS. Incubation was at 37° C. for 20 min. A 15 mL 180 uM stock of AMP was prepared in TM buffer.

Plates were spun down at 1500 rpm for 5 min and washed once with 200 uL PBS/well. Plates were spun down again and resuspended in 100 uL AMP. All other wells were resuspended in 100 uL TM buffer. The cells were incubated with AMP for 60 min at 37° C. A 7.5 mL 60 uM stock of ATP in TM buffer was prepared. Plates were spun down at 1500 rpm for 5 min and 50 uL of the supernatant was transferred to a black 96-well plate. 50 uL of ATP was added. rhCD73 was added to certain wells at 75 ng per well as a positive control. Wells that did not receive rhCD73 were brought up to 100 uL with TM buffer. Final concentration was 90 uM AMP: 30 uM ATP. Incubation was at 37° C. for 15 min. For the CellTiterGlo Assay (which detects ATP), 100 uL were added per well and the plate was read.

The results, which are shown in FIGS. 22A1, 22A2, 22B1, 22B2, and Table 20, indicate that the anti-CD73 antibodies inhibit dephosphorylation of AMP (or reduce AMP processing) in the human CD73 positive Calu6 cells, but have no effect in CD73 negative DMS 114 cells. The EC50 for blockade of endogenous cellular CD73 in the human tumor cell line Calu6 of CD73.4-IgG2S-IgG1.1f antibody is 0.39 nM (range 0.31 to 0.48 nM). These experiments were repeated in NCI-H292 (mucoepidermoid carcinoma cell line) and SK-MEL-24 (human melanoma cell line) cells and the results were similar (Table 20).

C. Inhibition of CD73 Enzymatic Activity in a Dual Cell Line cAMP Assay

Homogenous Time Resolved Fluorescence (HTRF) cAMP Assay

CD73 antibodies were serial diluted with PBS buffer containing 0.2% BSA, and plated 5 µl/well in 384 well white bottom proxiplate (PerkinElmer, Waltham, Mass.). Calu-6 cells were harvested and resuspend in PBS containing 0.2% BSA, then 5 µl of cells (300 cells/well) were added to the plate. The cells were incubated with antibodies for 10 minutes at 37° C. 5% $CO_2$ and 95% humidity, followed by the addition of 5 µl/well 80 M AMP. The cells were further incubated with AMP for 30 minutes at 37° C. During this time, HEK293/A2AR cells were harvested and diluted to 0.4 million/ml in PBS containing 0.2% BSA. They were added into the assay plate at 5 µl/well and continued to incubate at 37° C. for 1 hr. HRTF assays were performed using the homogenous time-resolved fluorescence (HTRF) HiRange cAMP detection kit (Cisbio, Bedford, Mass.) by adding 10 µl/well cAMP-conjugated d2 and 10µl/well europium cryptate conjugated anti-cAMP antibody in lysis buffer according to the manufacturer's instructions. Plates were incubated at room temperature for 60 minutes and Fluorescence Resonance Energy Transfer (FRET) signals (665 and 615 nM) were read using an EnVision plate reader (PerkinElmer, Waltham, Mass.). The FRET signal was calculated as the ratio of signal from the 665 nm (acceptor) and 615 nm (donor) channels and multiplied by 10,000. $IC_{50}$ and Ymax were measured. Ymax was determined by comparing to 100 nM dose of 11F11 as internal maximum. All calculations were determined as a percentage of inhibition compared to this control, which was set to 100%.

The results, which are shown in Table 21, indicate that the anti-CD73 mAbs demonstrated different efficacies and potencies in this cAMP assay using a cell line co-culture system. All Abs showed some reduction in adenosine production, and the extent of inhibition was similar for most Abs screened. The greatest inhibition was seen for 11F11, 11A6, 4C3 and 5F8.

TABLE 20

| Antibody | EC50 binding Calu6 [1] (nM) | EC50 enz. inhibition [2] (nM) | EC50 Calu6 inhibition [3] (nM) | EC50 SKMEL24 inhibition [3] (nM) | EC50 H292 inhibition [3] (nM) |
|---|---|---|---|---|---|
| 11F11 | 0.78 | 3.980 | 0.70 | 3.15 | 0.81 |
| 4C3 | 2.00 | 3.63 | 3.43 | 13.29 | 4.48 |
| 4D4 | 0.82 | 5.31 | | | |
| 11A6 | 1.93 | 3.12 | 2.21 | | |
| 5F8 | 11.65 | 5.76 | 8.10 | 110.19 | 13.46 |
| 7A11 | 0.35 | 2.86 | 0.95 | 3.72 | 1.31 |
| 24H2 | | 4.18 | | | |
| 10D2 | | 6.94 | | | |
| 6E11 | 0.63 | 3.71 | 1.54 | 3.43 | 1.34 |
| CD73.4-IgG2CS | 0.49 | 2.72 | 0.34 | | |
| CD73.4-IgG1.1f | 0.43 | 3.25 | 0.37 | | |
| CD73.4-IgG2S-IgG1.1f | 0.53 | 2.97 | 0.39 | | |
| CD73.10-IgG2S-IgG1.1f | 0.85 | 4.84 | 0.77 | | |
| CD73.10-IgG1.1f | 0.64 | 4.69 | 0.77 | | |
| CD73.10-IgG2S | 0.85 | 7.54 | 0.84 | | |

[1] Binding titration on Calu6 cells with endogenous CD73 expression. Antibodies were tested in 2-6 independent experiments, and the average value is indicated.
[2] Data from section A of this Example. Antibodies were tested in 1-5 independent experiments, and the average value is indicated.
[3] Inhibition of cellular CD73 activity in indicated cell line. Antibodies were tested in 2-4 independent experiments, and the average value is indicated.

TABLE 21

| Substance | IC50 (nM) | Ymax |
|---|---|---|
| APCP | 1.29 | 97 |
| 11A6 | 4.87 | 84 |
| 5F8 | 13.17 | 80 |
| 4C3 | 9.02 | 80 |
| 11F11 | 0.75 | 76 |
| 7A11 | 0.95 | 45 |

Enzymatic inhibition assays were also conducted with 11F11 Fab and F(ab')$_2$. The results, which are shown in FIG. 22C, indicated that enzymatic inhibition occurred with the F(ab')$_2$ fragment, but not with the Fab fragment. Thus, the Fc region is not required for 11F11 enzymatic inhibition, but bivalency is required.

Enzymatic inhibition in Calu6 cells was also determined for CD73.4 antibodies comprising various heavy chain constant regions, which are shown in Table 26, using the cAMP assay described above. The results, in terms of EC50 and level of inhibition versus background ("S:B") are provided in the last two columns of Table 28. The results indicate that all CD73.4 antibodies inhibit human CD73 enzymatic activity in Calu6 cells.

D. Time Course of CD73 Enzymatic Activity Inhibition

Inhibition of enzyme activity was also evaluated in a time course by evaluating adenosine generation by LC/MS/MS. Calu6 cells were incubated with 11F11 or 4C3 for 30 minutes, 2 hours or 4 hours, followed by addition of 50 µM AMP and evaluation of adenosine production by LC/MS/MS using standard methods.

Mass Spectrometry Conditions (Xevo TQ-S):
Instrument: Xevo TQ-S (with Waters 2777C)

| Tune = CD73_adenosine_MRM_tune2.ipr | |
|---|---|
| Ionization: (+) ESI | Desolvation Temp (° C.): 500 |
| Capillary (kV): 0.9 | Desolvation Gas (L/Hr): 1000 |
| Cone (V): see below | Cone Gas (L/Hr): 150 |
| Source Offset V): 50 | Nebuliser (Bar): 7.0 |
| LM Resolution 1: 2.81 | HM Resolution 1: 15.00 |
| LM Resolution 2: 2.93 | HM Resolution 2: 15.00 |
| Ion Energy 1: 0.4 | Ion Energy 2: 0.9 |
| Collision Gas Flow (mL/min): 0.15 | Collision: see below |
| Sample diverted to waste for first 0.5 min | |
| Waters Xevo TQ-S | Serial number: WAA021 |

The results, which are shown in FIG. 22D, indicate that incubation time does make a difference at the 30 min time point and that inhibition by 11F11 occurs faster than that by 4C3. Though both antibodies achieved equal inhibition at later timepoints, the 11F11 antibody more rapidly inhibits CD73 enzymatic activity in cells.

Example 6

Antibody Mediated Internalization of CD73

The anti-CD73 antibody mediated internalization of CD73 was measured in two different assays.

A. High-Content Internalization Assay (2 Hour Fixed Time Assay)

The anti-CD73 antibodies were used to test anti-CD73 antibody dependent CD73 internalization in Calu6 cells by assessing cellular expression after 2 hours of antibody incubation. Cells (2,000 cells/well) in 20 µl of complete medium (Gibco RPMI Media 1640 with 10% heat inactivated fetal bovine serum) were plated in 384 BD Falcon plate and grown overnight at 37° C. 5% CO$_2$ and 95% humidity. Anti-CD73 antibodies were serially diluted with PBS buffer containing (12% BSA, and added at 5 µl/well into the cell plate. The cells were incubated with antibodies for 2 hours at 37° C. 5% CO$_2$ and 95% humidity, followed by washing once with PBS buffer. Formaldehyde (final 4% in PBS) was then added into cell plate at 20 ul/well, and the plate was incubated at room temperature for 10 minutes. Afterwards, all liquid was aspirated and cells were washed once with 30 ul PBS. Detection antibody (2.5 µg/well of anti-CD73 Ab CD73.10.IgG2C219S) was added at 15 µg/well into the fixed cell plate. The cells were incubated at 4° C. overnight. On the next day, the plate was washed twice with PBS buffer, followed by adding secondary antibody containing Alexa-488 goat anti human and DAPI, stained for 1 hour at room temperature. After 3 washes in PBS buffer, the plate was imaged on Arrayscan Vti (Cellomics, Pittsburgh, Pa.). IC$_{50}$ and Ymax were measured. Ymax was determined by comparing to 100 nM dose of 11F11 as internal maximum. All calculations were determined as a percentage of internalization compared to this control, which was set to 100%.

The results are provided in Table 22.

TABLE 22

| mAb | Constant region | Epitope bin | EC50 (nM) | Ymax |
|---|---|---|---|---|
| 11F11 | IgG2 | 1 | 0.58 | 98 |
| 4C3 | IgG1 | 2 | ND | NA |
| 4D4 | IgG2 | 1 | 0.38 | 104 |
| 10D2 | IgG1 | 1 | ND | 29 |
| 11A6 | IgG1 | 1 | ND | NA |
| 24H2 | IgG1 | 1 | 8.2 | 51 |
| 5F8 | IgG1 | 2 | ND | NA |
| 6E11 | IgG1 | 1 | ND | NA |
| 7A11 | IgG1 | 1 | 2.59 | 50 |
| CD73.4 | IgG2-C219S-IgG1.1f | 1 | 1.2 | 97 |
| CD73.10 | IgG1.1f | 1 | 6.18 | 64 |
| CD73.10 | IgG2-C219S | 1 | 0.67 | 99 |
| CD73.10 | IgG2-C219S-IgG1.1f | 1 | 0.87 | 99 |

ND = Not Detected
NA = Not Applicable

Thus, the results indicate that the EC50 of CD73 internalization mediated by CD73.4.IgG2-C219S-IgG1.1f in the human CD73 expressing cell line Calu6 was 1.2 nM, and that the maximal level of internalization in the cell line was 97.5%.

Internalization assays were also conducted with 11F11 Fab and F(ab')$_2$. The results, which are shown in FIG. 22C, indicate that internalization occurred with the F(ab')$_2$ fragment, but not with the Fab fragment. Thus, the Fc region is not required for 11F11 internalization.

Kinetic internalization studies were performed to assess the rate of internalization. Cells (2,000 cells/well) in 20 µl of complete medium (Gibco RPMI Media 1640 with 10% heat inactivated fetal bovine serum) were plated in 384 BD Falcon plate and grown overnight at 37° C. 5% CO$_2$ and 95% humidity. CD73 antibodies were diluted with PBS buffer containing 0.2% BSA to 10 µg/ml and added 5 µl/well into the cell plate. The cells were incubated with antibodies for a 0-2 hour time course at 37° C., followed by washing once with PBS buffer. The cells were subsequently fixed with formaldehyde (final 4% in PBS) at room temperature for 10 minutes, and then washed once with 30 ul. PBS. Detection antibody (2.5 µg/well anti-CD73 Abs CD73.10.IgG2C219S) were diluted with PBS buffer containing 0.2% BSA, and added 15 µl/well into the fixed cell plate. The plate was incubated at 4° C. for overnight. On the next day, after 3 washes in PBS buffer, Secondary antibody Alexa488-goat anti human with DAPI were added. The cells were stained for 60 minutes at room temperature, after 3 washes, images were acquired using Arrayscan Vti (Cellomics, Pittsburgh, Pa.). The results are provided in FIGS. 23A-23D and Tables 23 and 24. The values in Table 24 derive from the data shown in FIGS. 23A-D.

of internalization. This trend was observed in several cell lines (FIGS. 23A-D and Table 24).

B. Internalization Measured by Flow Cytometry

Anti-CD73 antibody mediated internalization of CD73 was also tested by flow cytometry. Indicated cells were incubated with 10 μg/mL of the indicated antibody for 30 minutes on ice, washed several times, and transferred to 37°

TABLE 23

| Cell line | Cell type | 11F11(IgG2) $T_{1/2}$ (min) | 6E11 1$T_{1/2}$ (min) | CD73.10.IgG1.1f $T_{1/2}$ (min) |
|---|---|---|---|---|
| Calu6 | Human pulmonary adenocarcinoma | 3.9 | 60.9 | 14.4 |
| HCC44 | Non-small cell lung carcinoma | 3.3 | 27.9 | 23.5 |
| H2030 | Non-small cell lung carcinoma | 3.3 | 40.3 | 18.3 |
| H647 | Non-small cell lung carcinoma | 45.7 | N/A | N/A |
| H2228 | Non-small cell lung carcinoma | 10.9 | 36.5 | 35.7 |
| HCC15 | Non-small cell lung carcinoma | 2.2 | 84.4 | 37.9 |
| SKLU1 | Lung adenocarcinoma | 6.8 | 18.0 | 17.2 |
| SKMES1 | Melanoma | 2.2 | 62.8 | 32.3 |
| SW900 | Squamous cell lung carcinoma | 10.3 | 94.9 | 43.4 |

TABLE 24

$T_{1/2}$ and % internalization of CD73 antibodies in 4 human cell lines

| | H228 cells | | HCC15 cells | | Calu6 cell | | H2030 cells | |
|---|---|---|---|---|---|---|---|---|
| | $T_{1/2}$ min | % internalization | $T_{1/2}$ min | % internalization | $T_{1/2}$ min | % internalization | $T_{1/2}$ min | % internalization |
| CD73.11-IgG2CS | — | — | — | — | 4.1 | 89 | 4.6 | 85 |
| CD73.10-IgG2CS | 9.7 | 93 | 2.6 | 91 | 3.0 | 91 | 3.3 | 85 |
| CD73.10-IgG2CS-IgG1.1f | 9.4 | 92 | 3.0 | 91 | 3.1 | 91 | 4.3 | 87 |
| CD73.4-IgG2CS | 13.8 | 94 | 3.1 | 94 | 6.5 | 88 | 3.7 | 89 |
| CD73.10-IgG1.1f | 35.7 | 33 | 37.9 | 71 | 14.4 | 63 | 18.3 | 67 |
| CD73.3-IgG1.1f | 16.5 | −47 | >240 | 38 | 111.4 | 79 | >120 | 27 |
| 11F11 | 10.9 | 96 | 2.2 | 94 | 3.9 | 87 | 3.3 | 90 |
| 4C3 | 7.6 | −48 | 141.5 | 28 | 0.6 | −6 | >120 | −34 |
| 6E11 | 36.5 | 13 | 84.4 | 64 | 107.4 | 68 | 40.32 | 51 |

The results indicate that the bin 1 antibodies (11F11 and its derivatives CD73.4 and CD73.10) showed good internalization $EC_{50}$ and maximal values (97.5%), although some antibodies were more internalized than others. 11F11 was the most active and internalized within minutes, reaching a plateau in 30 minutes, whereas 6E11 (also a bin 1 antibody, IgG1) internalized more slowly, reaching a plateau at about 1 hr (FIGS. 23A-D). The bin 2 antibodies (5F8 and 4C3) did not internalize significantly. In addition, the presence of IgG2 hinge and CH1 domain enhanced the speed and extent C. for the indicated time. Cells were harvested at the same time after the indicated incubation time. Cells were stained with primary antibody again (same antibody used for initial incubation) followed by anti-human secondary antibody. Cells were then assayed for expression of CD73 by flow cytometry.

Figure 23A:
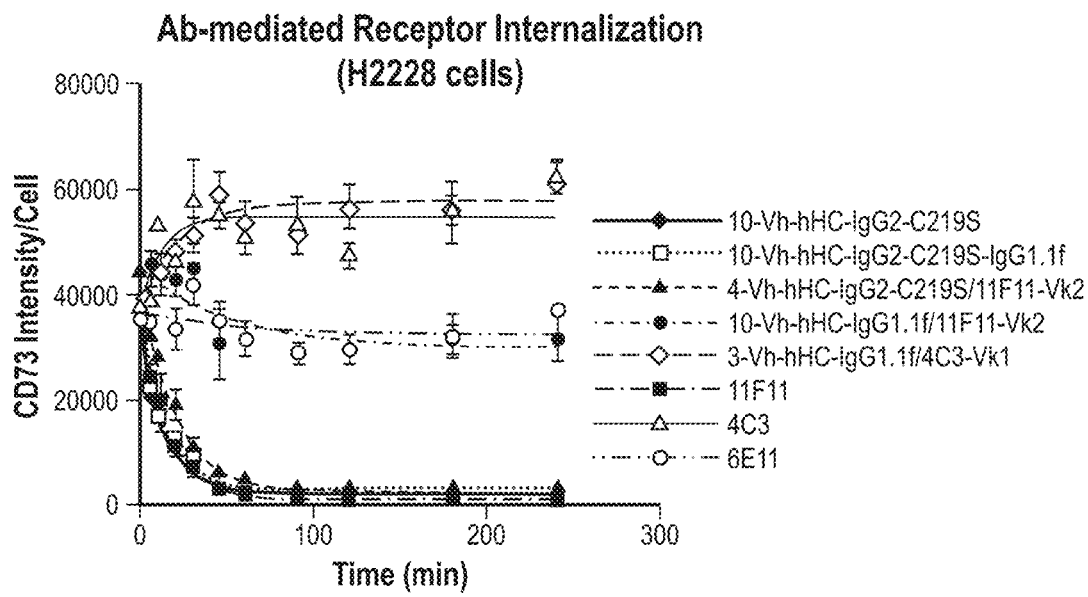
FIG. 23A shows the kinetics of antibody mediated internalization of CD73 by the following antibodies: 11F11, 4C3, 6D11, CD73.3-IgG1.1f with the 4C3Vk1 light chain ("3-Vh-hHC-IgG1.1f/4C3Vk1"), CD73.4-IgG2CS with the 11F11 Vk2 light chain ("4-Vh-hHC-IgG2-C219S/11F11-Vk2"), CD73.10-IgG2CS ("CD73.10-Vh-hHC-IgG2-C219S"), CD73.10-IgG2CS-IgG1.1f ("CD73.10-Vh-hHC-IgG2-C219S-IgG1.1f"), and CD73.10-IgG1.1f ("CD73.10-Vh-hHC-IgG1.1f") antibodies in H2228 cells. The 11F11 (which is of an IgG2 isotype), CD73.4-IgG2CS, CD73.10-IgG2CS and CD73.10-IgG2CS-IgG1.1f antibodies are internalized faster and to a higher degree than the other tested antibodies, which are of an IgG1 isotype.
Figure 23B:
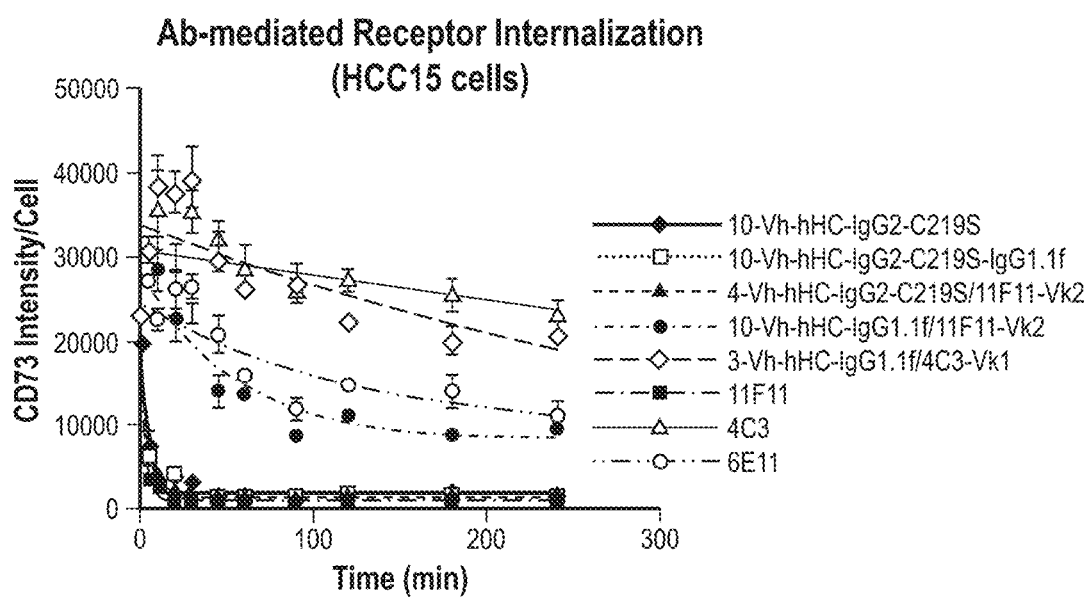
FIG. 23B shows the kinetics of antibody mediated CD73 internalization of the same antibodies as those shown in FIG. 23A in HCC15 cells (non-small cell lung carcinoma cell line), showing similar results to those obtained in H2228 cells (non-small cell lung carcinoma cell line).
Figure 23C:
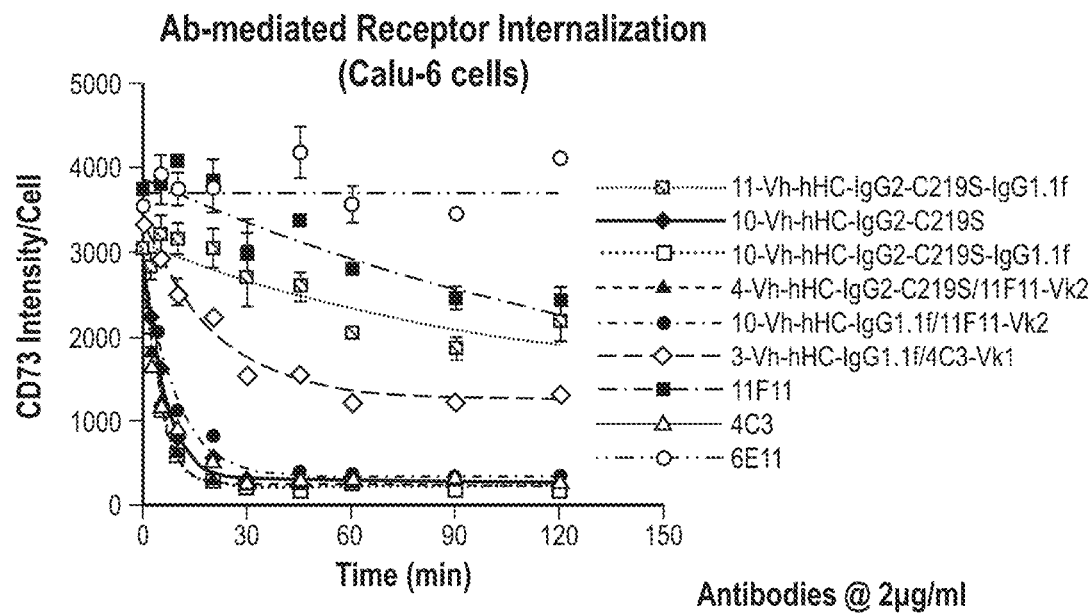
FIG. 23C shows the kinetics of antibody mediated CD73 internalization of the same antibodies as those shown in FIGS. 23A and 23B, as well as CD73.11-IgG2CS ("11-Vh-hVC-IgG2-C219S"), in Calu6 cells, showing similar results to those obtained in H2228 and HCC15 cells.
Figure 23D:
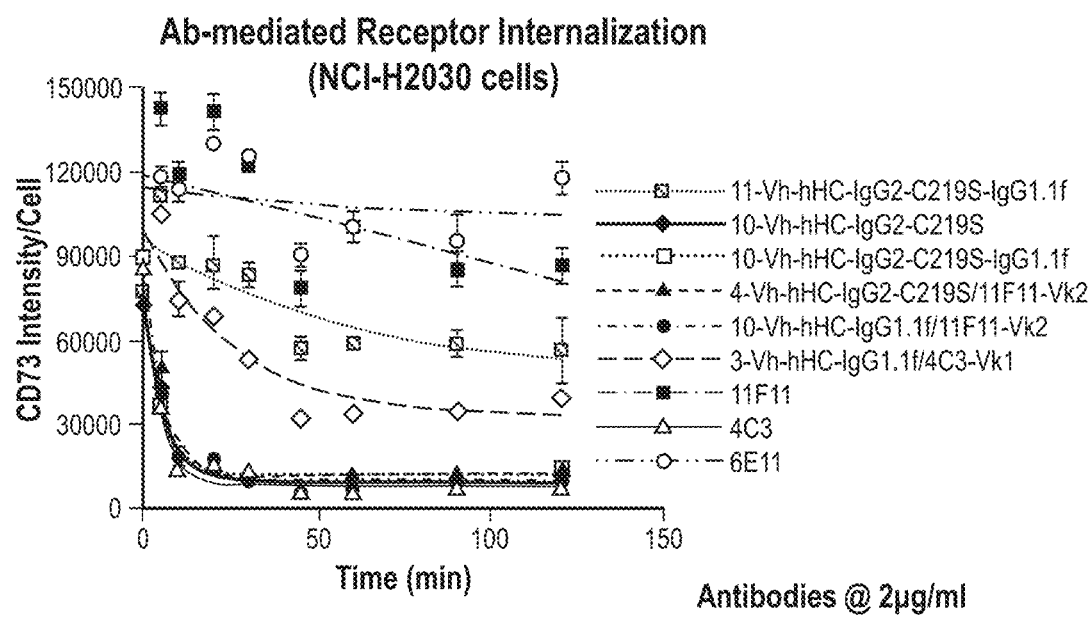
FIG. 23D shows the kinetics of antibody mediated CD73 internalization of the same antibodies as those shown in FIG. 23C in NCI-2030 cells (non-small cell lung carcinoma cell line), showing similar results to those obtained in H2228, HCC15, and Calu6 cells.
Figure 23E:
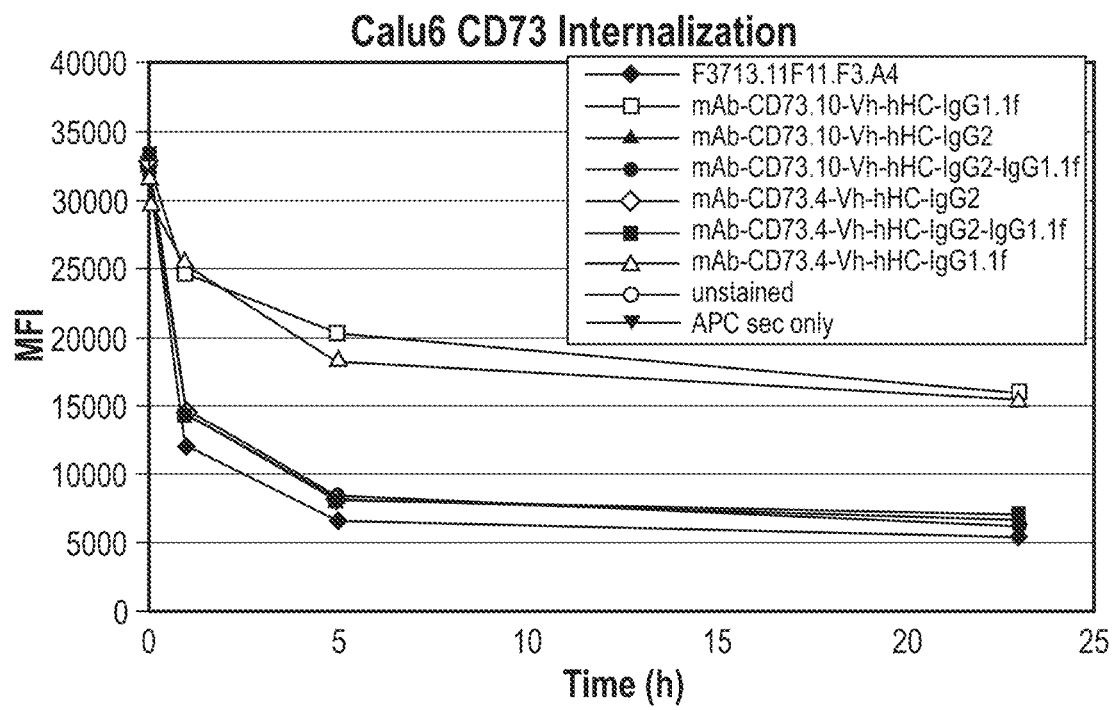
FIG. 23E shows the kinetics of antibody mediated CD73 internalization of the indicated antibodies in Calu6 cells, as measured by flow cytometry.

The results, which are shown in FIG. 23E and Table 25, are consistent with those obtained in the internalization assays described above, and indicate that, all antibodies with IgG2 hinge and CH1 induced rapid and complete internalization. The CD73 levels remained low after 22 hours post wash-out, indicating that internalization is durable.

Figure 23F:
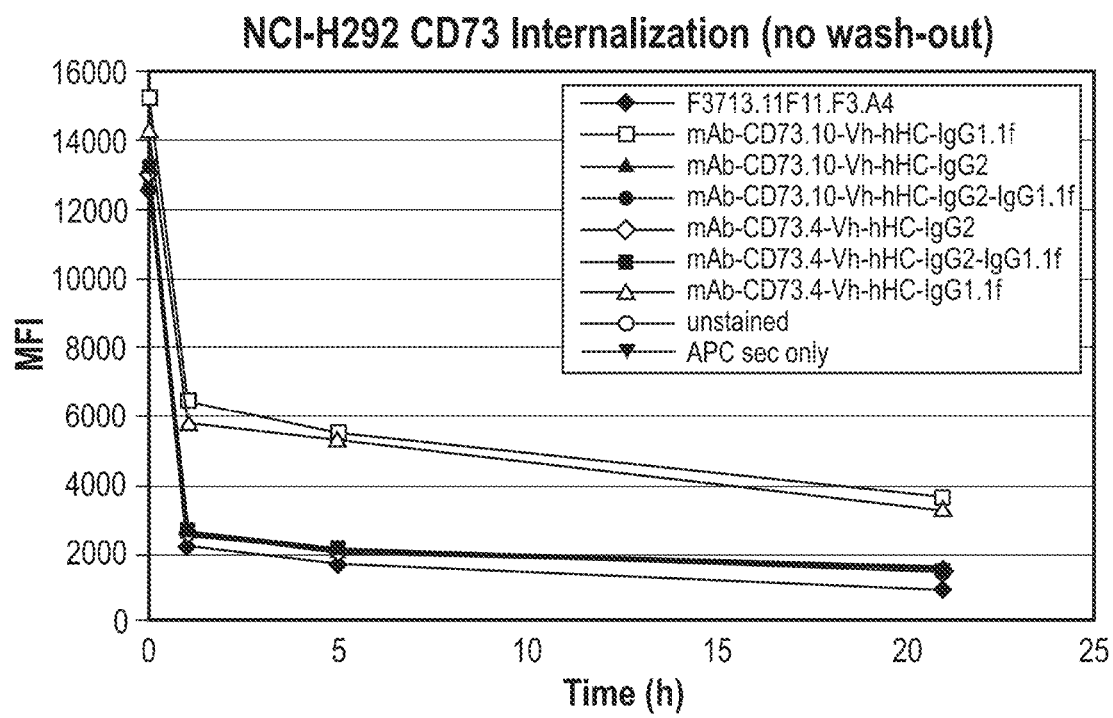
FIG. 23F shows the kinetics of antibody mediated CD73 internalization of the indicated antibodies in NCI-H292 cells (mucoepidermoid pulmonary carcinoma cell line), as measured by flow cytometry, but where the antibodies were not washed out after the first incubation of the cells with the antibodies.

Similar results, shown in FIG. 23F and Table 25, were obtained in the NCI-H292 cell line, in which antibody was maintained in culture during the incubation time (no wash-out). Again, these data indicate rapid and significant internalization and maintenance of downregulation of endogenous CD73.

Figure 23G:
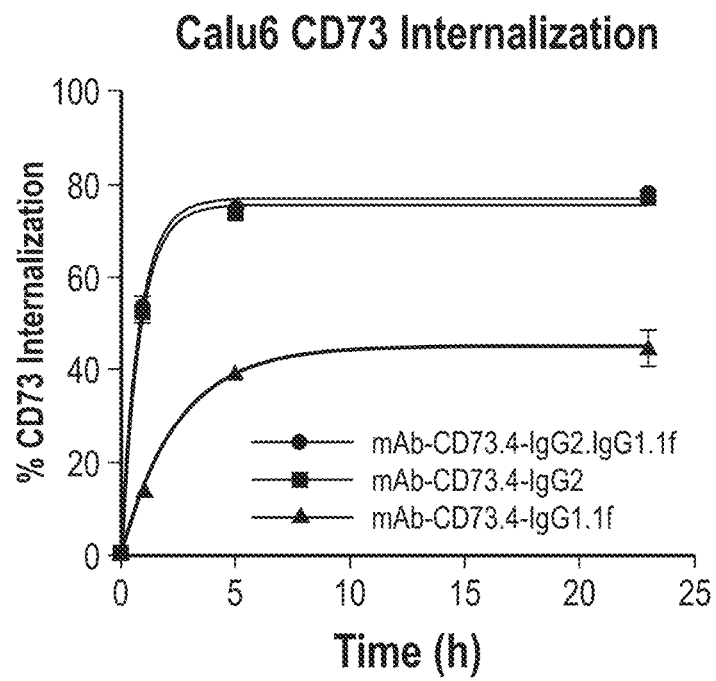
FIG. 23G shows the percentage of CD73 internalized in Calu6 cells treated with the indicated antibodies, showing antibody mediated CD73 internalization of the indicated antibodies in Calu6 cells over time.
Figure 23H:
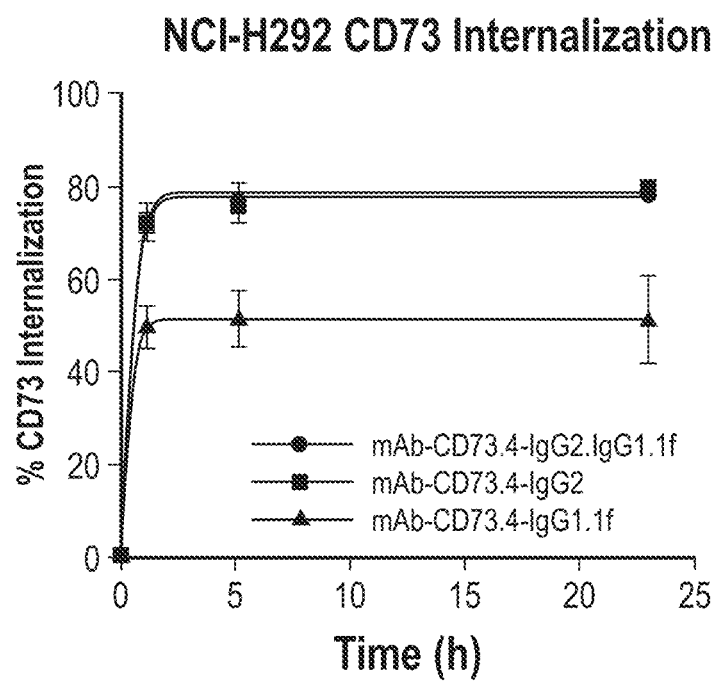
FIG. 23H shows the percentage of CD73 internalized in NCI-H292 cells treated with the indicated antibodies over time, showing antibody mediated CD73 internalization of the indicated antibodies in NCI-H292 cells over time.
Figure 23I:
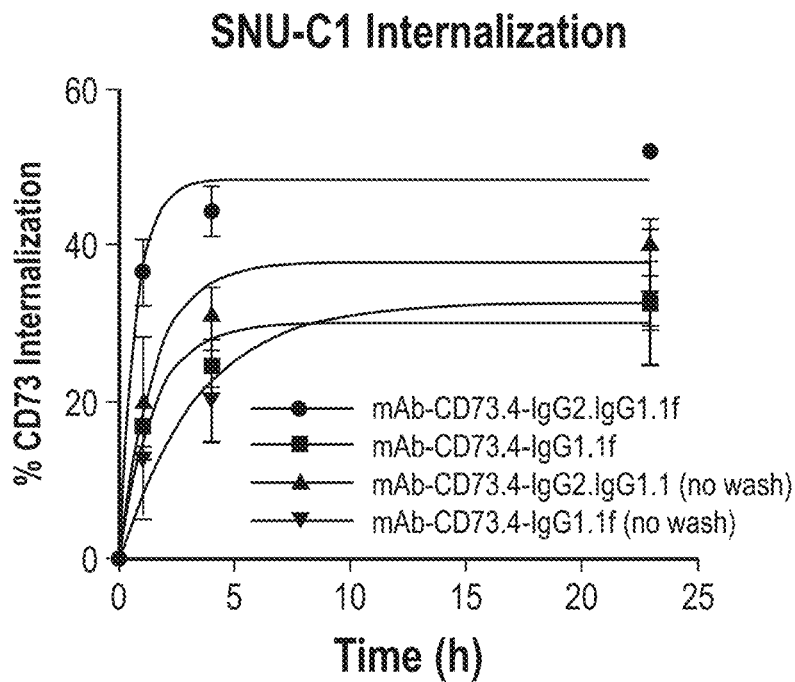
FIG. 23I shows the percentage of CD73 internalized in SNU-C1 cells (colon carcinoma cell line) treated with the indicated antibodies over time, showing antibody mediated CD73 internalization of the indicated antibodies in SNU-C1 cells over time.
Figure 23J:
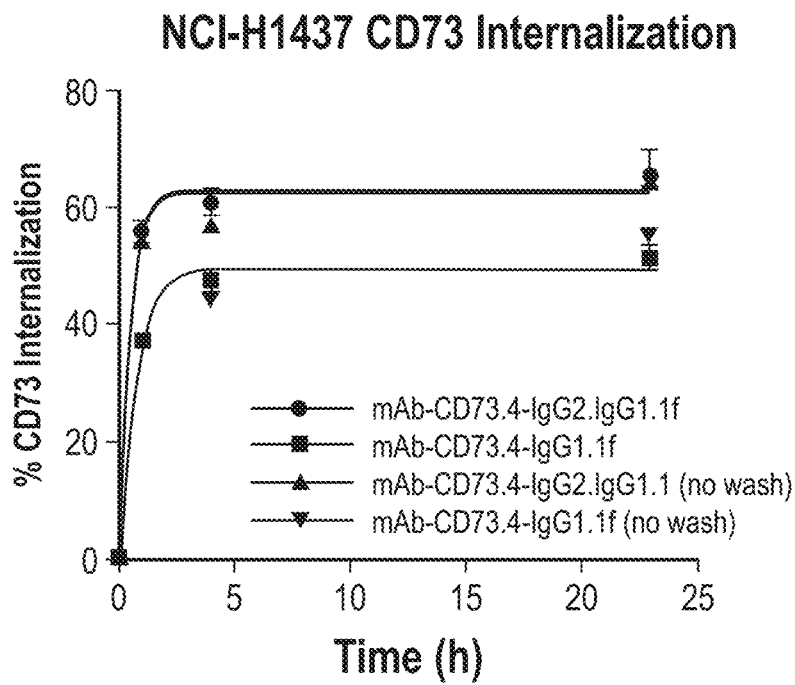
FIG. 23J shows the percentage of CD73 internalized in NCI-H1437 cells (non-small cell lung carcinoma cell line) treated with the indicated antibodies over time, showing antibody mediated CD73 internalization of the indicated antibodies in NCI-H1437 cells over time.
Figure 23M:
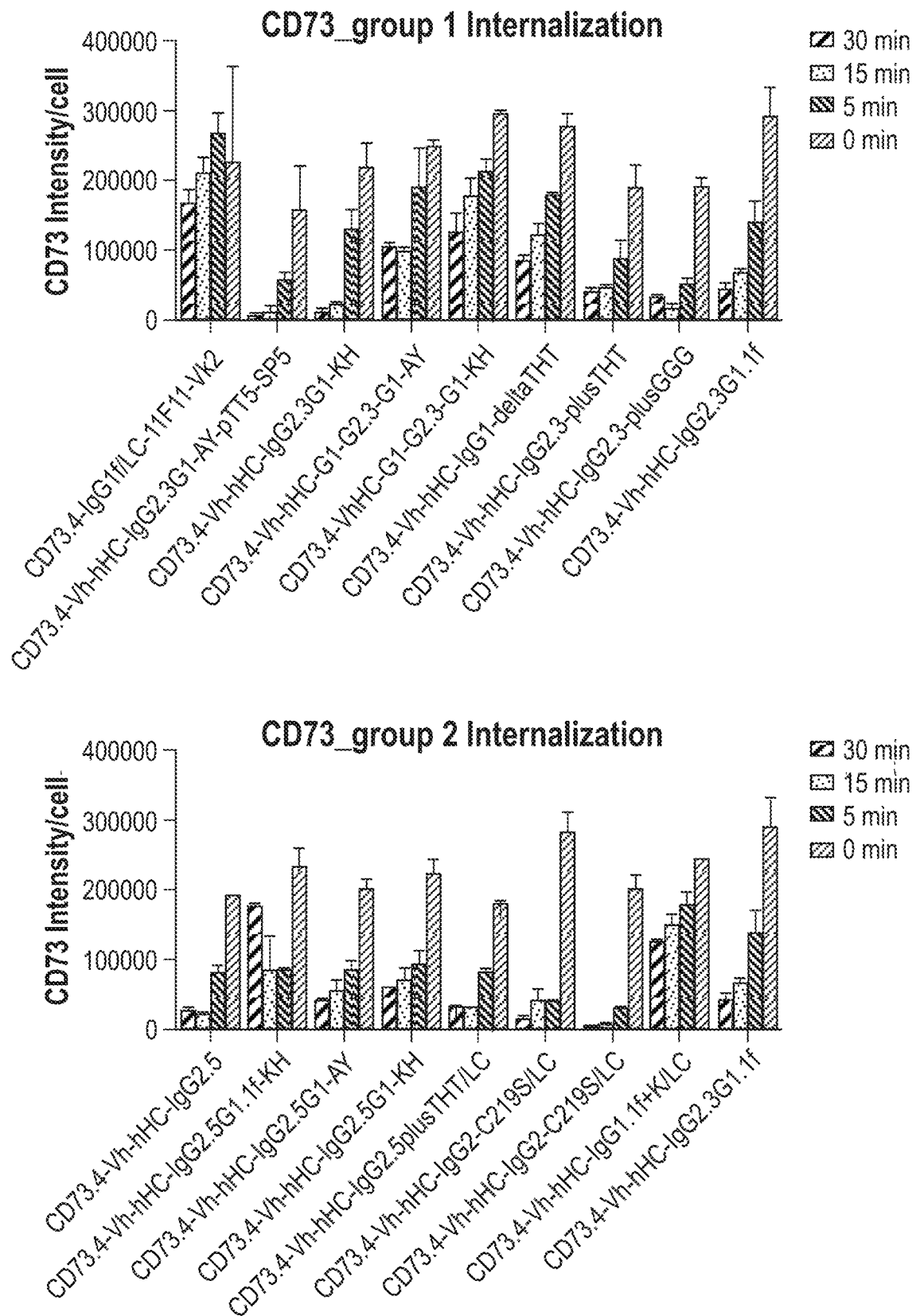
FIG. 23M shows the level of CD73 on the surface of Calu6 cells treated with 5 µg/ml of the indicated antibodies for 0, 5, 15 or 30 minutes.

Internalization assays were also conducted with the human SNU-C1 (colon cancer cell line) and NCI-H1437 (non-small cell lung carcinoma cell line) cells. The results, which are shown in FIGS. 23I and J and Table 25, also indicate rapid internalization with a maximal level reached within 5 hours and a maximal level of internalization of about 50% for CD73.4.IgG2-C219S-IgG1.1f in SNU-C1 and 60% for NCI-H1437 cells. FIGS. 23G and H show similar kinetics of internalization of CD73.4.IgG2-C219S-IgG1.1f in Calu6 and NCI-H292 cells. For graphs, which show % of CD73 internalized, this number was obtained as follows:

$$\% \ CD73 \ internalized = 100 - \left(\frac{MFI_{t=x} - MFI_{background}}{MFI_{t=0} - MFI_{background}} \times 100\right)$$

where for each antibody, $MFI_{t=x}$ is the MFI at a given timepoint and $MFI_{t=0}$ is maximal fluorescence at t=0, and $MFI_{background}$ is the MFI of the secondary Ab only.

TABLE 25

EC$_{50}$s of antibody mediated CD73 internalization in several cell lines

|  | Calu6 | | NCI-H292 | | SNU-C1 | | SNU-C1 (no wash) | | NCI-H1437 | | NCI-H1437 (no wash) | |
| --- | --- | --- | --- | --- | --- | --- | --- | --- | --- | --- | --- | --- |
|  | Ymax (hr) | T$_{1/2}$ (hr) | Ymax (hr) | T$_{1/2}$ (hr) | Ymax (hr) | T$_{1/2}$ (hr) | Ymax (%) | T$_{1/2}$ (hr) | Ymax (%) | T$_{1/2}$ (hr) | Ymax (%) | T$_{1/2}$ (hr) |
| mAb-CD73.4-IgG2-IgG1.1f | 76.8 | 0.5661 | 77.64 | 0.2633 | 48.96 | 0.4954 | 38.39 | 1.025 | 63.12 | 0.3164 | 62.78 | 0.3418 |
| mAb-CD73.4-IgG2 | 75.59 | 0.6003 | 78.42 | 0.2766 | — | — | — | — | — | — | — | — |
| mAb-CD73.4-IgG1.1f | 44.99 | 1.737 | 51.49 | 0.2087 | 30.58 | 0.9915 | 33.16 | 2.33 | 49.76 | 0.4915 | 49.95 | 0.5384 |

Additional internalization assays were conducted in Calu6 and H292 cells to further discriminate the role of isotype on internalization. The internalization assays were conducted as described above (protocol without the washout step of the antibodies), and the antibodies of varying hybrid isotypes shown in Table 26 were maintained in culture at 10 µg/mL during the incubation time. For the flow cytometry experiments, the method of Example 6B was adapted to high throughput analysis in 96 well plates (as opposed to 48 well plates) and with 50,000 cells per well.

TABLE 26

Constant regions tested with the variable regions of CD73.4:

| Constructs | SEQ ID NO of constant region | Description |
| --- | --- | --- |
| IgG1f | 267 | wild type IgG1f |
| IgG1.1f | 272 | standard inert IgG1.1f |
| IgG2.3 | 268 | IgG2 A-form (C219S) |
| IgG2.5 | 271 | IgG2 B-form (C131S) |
| IgG2.3G1-KH | 270 | CH1, upper hinge and lower hinge/upper CH2 of IgG2.3, all else IgG1f |
| IgG2.5G1-KH | 279 | CH1, upper hinge and lower hinge/upper CH2 of IgG2.5, all else IgG1f |
| IgG2.3G1-AY | 269 | CH1 and upper hinge of IgG2.3, all else IgG1f |
| IgG2.5G1-AY | 278 | CH1 and upper hinge of IgG2.5, all else IgG1f |
| IgG1-G2.3G1-KH | 282 | CH1 of IgG1, upper hinge and lower hinge/upper CH2 of IgG2.3, all else IgG1f |
| IgG1-G2.3G1-AY | 281 | CH1 of IgG1, upper hinge of IgG2.3, all else IgG1f |
| IgG2.3G1.1f-KH | 273 | CH1, upper hinge and lower hinge/upper CH2 of IgG2.3, all else IgG1.1f |
| IgG2.5G1.1f-KH | 277 | CH1, upper hinge and lower hinge/upper CH2 of IgG2.5, all else IgG1.1f |
| IgG1-deltaTHT | 274 | IgG1 with THT sequence removed from hinge |
| IgG2.3-plusTHT | 275 | IgG2.3 with THT sequence (from IgG1) added into hinge |
| IgG2.5-plusTHT | 280 | IgG2.5 with THT sequence (from IgG1) added into hinge |
| IgG2.3-plusGGG | 276 | IgG2.3 with flexible GGG sequence added into hinge |

FcγR binding was shown to be as expected for each construct, i.e., FcγR binding is driven by lower hinge/CH2 region.

The results are shown in FIGS. 23K, L, M and in Table 27 and 28. Data shown in Table 27 were generated using the same protocol described in Example 6B. Data shown in Table 28 were generated using the same protocol described in Example 6A.

TABLE 27

Ymax and T$_{1/2}$ of antibody mediated CD73 internalization in Calu6 and NCI-292 cells

|  | Calu6 | | NCI-H292 | |
| --- | --- | --- | --- | --- |
|  | Ymax (%) | T$_{1/2}$ (hr) | Ymax (%) | T$_{1/2}$ (hr) |
| mAb-CD73.4-IgG1f/LC-11F11-Vk2 | 55.72 | 0.8452 | 73.05 | 0.5014 |
| mAb-CD73.4-IgG2.3G1-AY-pTT5-SP | 85.07 | 0.3326 | 90.25 | 0.272 |
| mAb-CD73.4-IgG2.3G1-KH | 81.62 | 0.3962 | 91.61 | 0.2801 |
| mAb-CD73.4-G1-G2.3-G1-AY | 72.7 | 0.4229 | 84.51 | 0.3083 |
| mAb-CD73.4-IgG1-deltaTHT | 69.27 | 0.5652 | 83.63 | 0.3441 |
| mAb-CD73.4-G1-G2.3-G1-KH | 65.67 | 0.5674 | 83.29 | 0.343 |
| mAb-CD73.4-IgG2.3-plusTHT | 81.19 | 0.3551 | 91.41 | 0.2935 |
| mAb-CD73.4-IgG2.3-plusGGG | 81.72 | 0.3355 | 91.6 | 0.2712 |
| mAb-CD73.4-IgG2.5 | 78.98 | 0.3485 | 89.56 | 0.3057 |
| mAb-CD73.4-IgG2.5G1.1f-KH | 79.63 | 0.3527 | 90.86 | 0.2993 |
| mAb-CD73.4-IgG2.5G1-AY | 81.91 | 0.2901 | 91.3 | 0.2452 |
| mAb-CD73.4-IgG2.5G1-KH | 76 | 0.2837 | 90.75 | 0.256 |
| mAb-CD73.4-IgG2.5plusTHT/LC | 80.15 | 0.2869 | 89.6 | 0.2565 |
| mAb-CD73.4-IgG2-C219S/LC | 82.35 | 0.3725 | 88.91 | 0.2866 |
| mAb-CD73.4-IgG2-C219S/LC | 82.54 | 0.3639 | 87.66 | 0.2845 |
| mAb-CD73.4-IgG1.1f+K/LC | 57.07 | 1.519 | 70.4 | 0.4969 |
| mAb-CD73.4-IgG2CS-IgG1.1f | 80.98 | 0.3508 | 90.35 | 0.2764 |

TABLE 28

Internalization and enzyme inhibition characteristics
of CD73.4 with various constant regions in Calu6 cells

| # | CD73_mAb_Clones | Internalization Max | Internalization Speed | CD73 Inhibition EC50 (nM) | S:B |
|---|---|---|---|---|---|
| 1 | CD73.4-IgG1f/LC-11F11-Vk2 | + | + | 2.01 | 2 |
| 2 | CD73.4-Vh-hHC-IgG2.3G1-AY-pTT5-SP5 | ++++ | ++++ | 2.37 | 56 |
| 3 | CD73.4-Vh-hHC-IgG2.3G1-KH | ++++ | +++ | 1.70 | 52 |
| 4 | CD73.4-Vh-hHC-G1-G2.3-G1-AY | ++ | ++ | 0.38 | 6 |
| 5 | CD73.4-Vh-hHC-G1-G2.3-G1-KH | ++ | ++ | 0.63 | 3 |
| 6 | CD73.4-Vh-hHC-IgG1-deltaTHT | ++ | +++ | 0.31 | 6 |
| 7 | CD73.4-Vh-hHC-IgG2.3-plusTHT | ++++ | ++++ | 1.54 | 33 |
| 8 | CD73.4-Vh-hHC-IgG2.3-plusGGG | ++++ | ++++ | 1.26 | 26 |
| 9 | CD73.4-Vh-hHC-IgG2.5 | ++++ | ++++ | 2.17 | 51 |
| 10 | CD73.4-Vh-hHC-IgG2.5G1.1f-KH | ++ | ++++ | 0.87 | 45 |
| 11 | CD73.4-Vh-hHC-IgG2.5G1-AY | +++ | ++++ | 0.43 | 92 |
| 12 | CD73.4-Vh-hHC-IgG2.5G1-KH | +++ | ++++ | 0.44 | 42 |
| 13 | CD73.4-Vh-hHC-IgG2.5plusTHT/LC | ++++ | ++++ | 0.90 | 44 |
| 14 | CD73.4-Vh-hHC-IgG2-C219S/LC | ++++ | ++++ | 1.56 | 28 |
| 15 | CD73.4-Vh-hHC-IgG2-C219S/LC | ++++ | ++++ | 1.78 | 41 |
| 16 | CD73.4-Vh-hHC-IgG1.1f+K/LC | + | + | 0.70 | 2 |
| 17 | CD73.4-Vh-hHC-IgG2C219S-IgG1.1f | ++++ | ++++ | 1.28 | 12 |

FIGS. 23K, L and M and Tables 27 and 28 indicate that antibodies having a hinge and CH1 domain of the IgG2 isotype are most efficient at driving internalization of CD73, whereas the antibodies that have an IgG1 hinge and CH1 domain correspond to the lower curves in the figure, i.e., lower extent of internalization. In addition, antibodies with only the hinge from IgG2 have an increased internalization compared to a human IgG1 hinge. Thus, antibodies having a hinge and CH1 domain of the IgG2 isotype have superior internalization characteristics relative to the antibodies with an IgG1 isotype.

Thus, anti-CD73 antibody mAb-CD73.4-IgG2CS-IgG1.1f induced rapid internalization dependent on cell line tested. The T½ for internalization ranged from minutes to under an hour. Most cell lines tested had a T½ under 10 minutes. A nearly complete internalization was induced for some cell lines and all tested had at least a 50% reduction in surface CD73 expression which typically reached maximal levels by 5 hours, much shorter in some cases.

The SEC-MALS and DLS data demonstrate that larger complexes are formed between hCD73-his and mAbs containing an IgG2 hinge and CH1 region (IgG2-C219S or IgG2-C219S-IgG1.1f), compared to those containing the IgG1 hinge and CH1 region (IgG1.1f).

Example 7

CD73 Enzymatic Inhibition in Tumors in Xenograft Animal Models

Mice bearing subcutaneous human Calu6 tumors were treated with CD73.10-IgG1.1, CD73.10-IgG2CS, or CD73.10-IgG2CS-IgG1.1 after 7 days of growth. Antibodies were dosed at 10 mg/kg IP. Tumors were harvested at days 1, 2, 3 and 7 after antibody administration, embedded in OCT and snap frozen in chilled isopentane. OCT embedded tumors were cut in 5-6 μm sections and allowed to dry over night at RT. Tumor sections were fixed for 2.5 min with a 1:1 mixture of cold 10% phosphate-buffered formalin and acetone then preincubated for 1 hour at RT in 50 mM Tris-maleate buffer, pH 7.4 containing 2 mM CaCl2 and 0.25 M sucrose. After 1 hour the preincubation buffer was removed and was replaced with the same buffer supplemented with 5 mM $MnCl_2$, 2 mM Pb(NO3)2, 2.5% Dextran T200, 2.5 mM levamisole, and 1 mM AMP. The enzymatic reaction was carried out for 1 h at 37° C. After a rinse with DI water, sections were incubated for exactly 1 min with 1% $(NH_4)_2S$ followed by a quick rinse in DI water. Sections were counterstained with haematoxylin, dehydrated and mounted with a xylene based mounting medium. A brown color indicates the presence of active CD73, whereas the lack of brown color indicates that CD73 enzymatic activity was inhibited by the antibody.

Figure 24E:
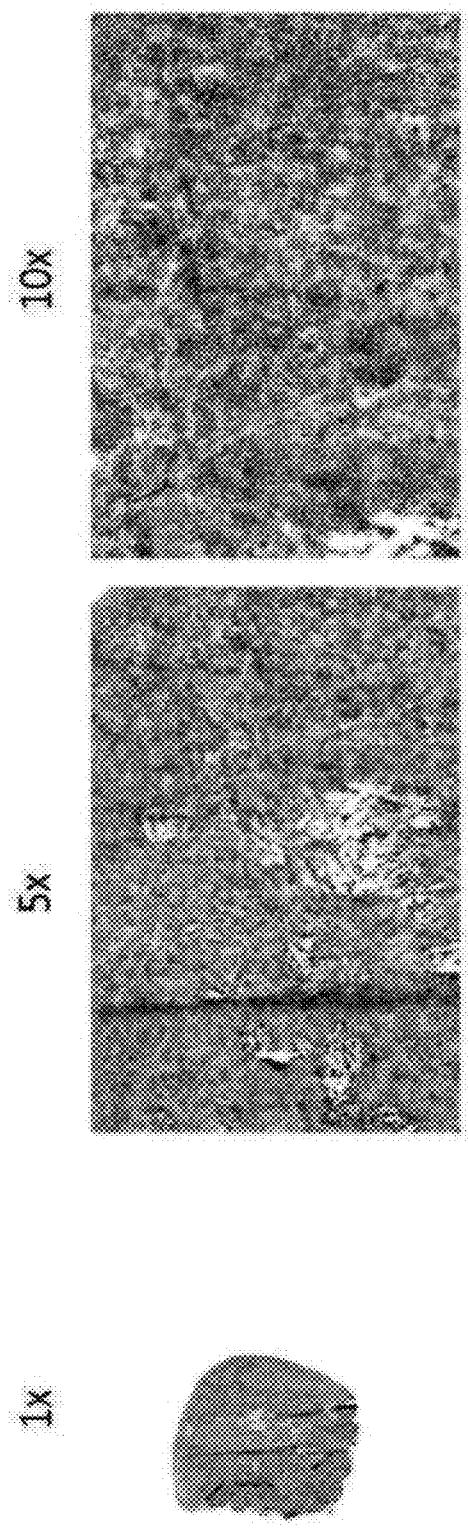
FIG. 24E shows xenograft tumor sections from animals harvested 7 days after treatment of the animals with CD73.10-IgG2CS-IgG1.1f and stained for CD73 enzymatic activity. The sections show significantly less brown color relative to the control tumor sections shown in FIG. 24A, indicating in vivo inhibition of CD73 enzymatic activity by CD73.10-IgG2CS-IgG1.1f at least 7 days after the start of the treatment.

The results indicate that CD73.10-IgG1.1, CD73.10-IgG2CS, and CD73.10-IgG2CS-IgG1.1 inhibit CD73 enzymatic activity in vivo. Representative stained sections of the tumors from mice treated with the CD73.10-IgG2CS-IgG1.1 antibody are shown in FIGS. 24 A-E. The stained sections of tumors from mice treated with the other two antibodies were similar. The extent of inhibition of CD73 correlated with serum levels of antibody. Thus the slightly higher level of CD73 activity observed in the Day 3 example correlated with a lower serum level of antibody than the Day 7 example.

A similar experiment to that described above was conducted on mice bearing subcutaneous human SNUC1 colon adenocarcinoma-derived xenograft tumors and treated with the anti-CD73 antibody CD73.4IgG2CS-IgG1.1f. Mice with SNUC1 tumors were treated with CD73.4IgG2CS-IgG1.1f at 1, 3 and 10 mg/kg IP on day 0. Tumors were harvested at 24 h, 48 h, 72 h, 96 h and 168 h after dosing. The CD73 enzymatic inhibition assay was performed as described above. The quantification of brown staining was performed with Image Pro Premier software (Media Cybernetics).

Figure 24F:
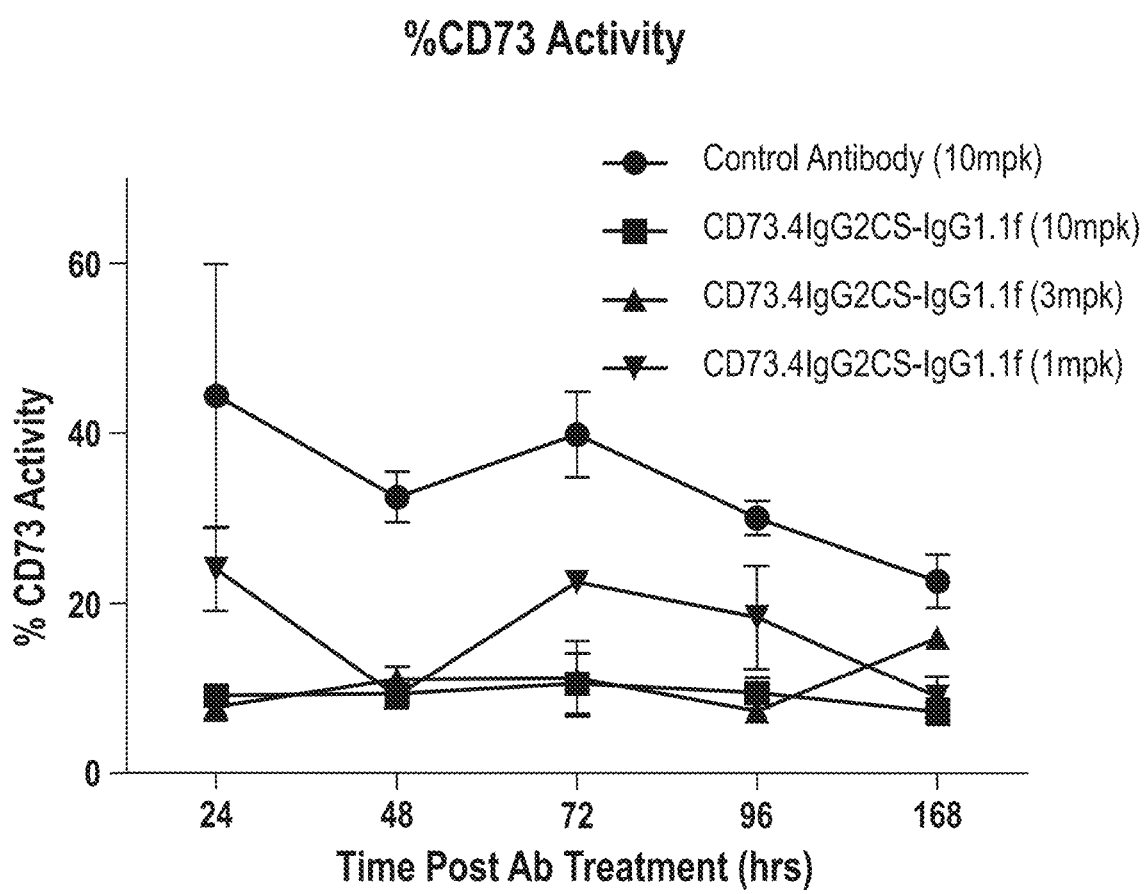
FIG. 24F shows a time course of the enzymatic activity of human CD73 in SNUC1 tumors in xenograft mice treated with a control (non CD73) antibody or with 1 mg/kg, 3 mg/kg or 10 mg/kg CD73.4-IgG2CS-IgG1.1f, showing that the anti-CD73 antibody efficiently reduces CD73 enzymatic activity in the tumors of the xenograft mice.
Figure 25B:
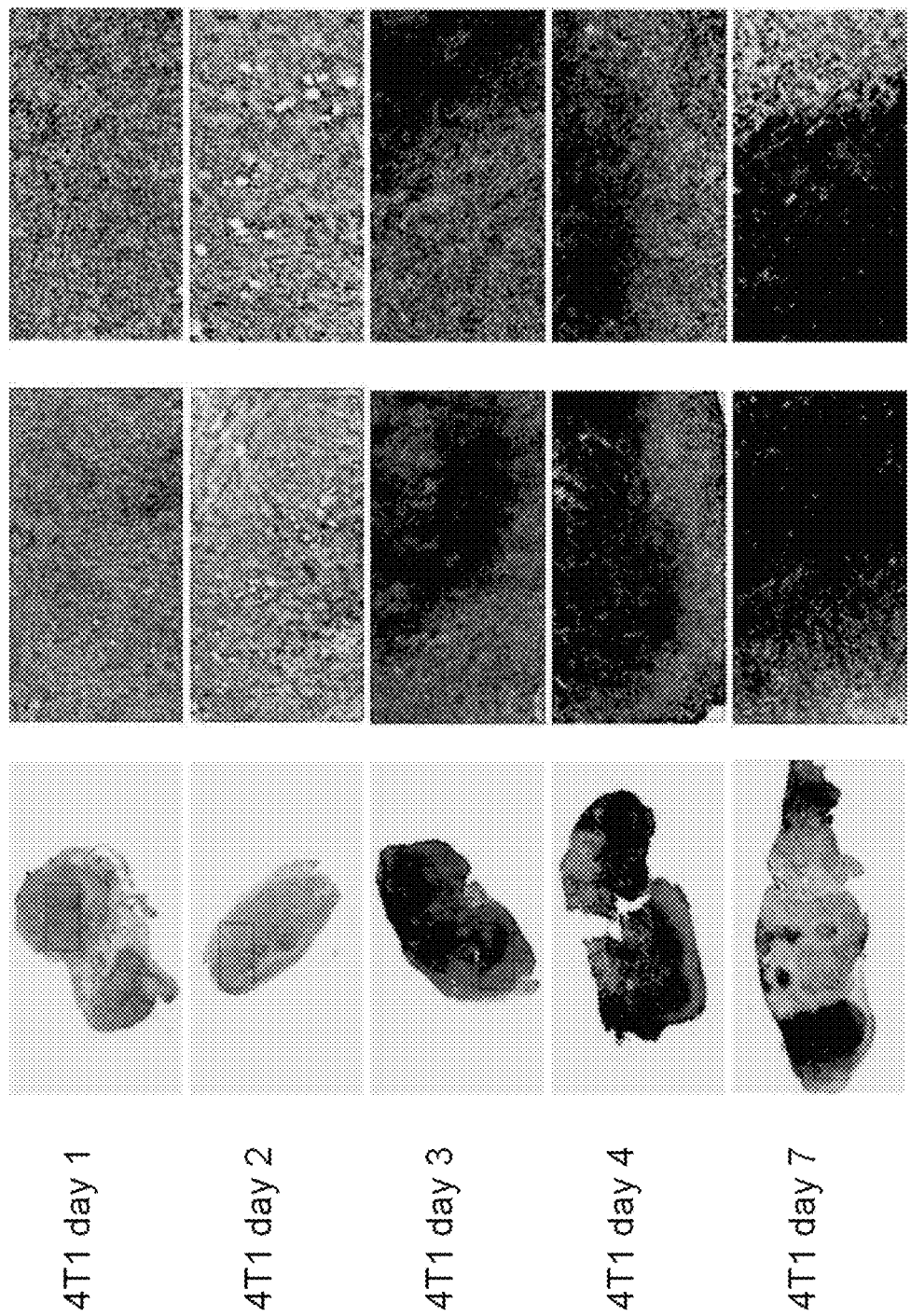
FIG. 25B shows tumor sections (4T1 days 1-7) of Balb/c mice bearing syngeneic 4T1 tumors subcutaneously treated with anti-mouse CD73 antibody TY23, showing that TY23 inhibits CD73 enzymatic inhibition in vivo.

The results, which are presented in the graph in FIG. 24F, show that CD73 activity is significantly reduced animals dosed with the anti-CD73 antibody when compared with control antibody-treated mice, indicating strong CD73 enzyme inhibition by the antibody at all three concentrations. Thus, the anti-CD73 antibody CD73.4CS-IgG1.1f efficiently inhibits CD73 enzymatic activity in vivo. The kinetics of CD73 inhibition by the anti-CD73 antibodies was also determined in the 4T1 syngeneic tumor model. TY/23 (rat anti-mouse CD73 antibody) or rat IgG control (10 mg/kg) was injected on day 7 post 4T1 tumor cell injection. Tumor, spleen, whole blood and serum were collected on days 1, 2, 3, 6 and 7 after Ab treatment. Inhibition of CD73 activity was measured as described above in sections from the indicated day. Representative tumor sections are shown in FIGS. 25 A and B. The data indicate that TY/23 inhibits CD73 activity in vivo.

Example 8

Epitope Binning and Flow Cytometry Based Cross-Blocking

Epitope binning studies were performed by Biolayer Interferometry (BLI) using an Octet RED instrument (Pall Fortebio) at 25° C. For these studies, 20-30 ug/ml hCD73-his was captured on anti-penta-his sensors using a 90-180s loading phase. Antibody competition was evaluated by allowing a given antibody (mAb1) to bind to the hCD73-his surfaces for 180s, followed by the immediate exposure to a second antibody solution (mAb2) for 180s. The binding signal for mAb2 after pre-binding of mAb1 was compared to that of mAb2 in the absence of competition, to determine if mAb1 and mAb2 compete for binding to the hCD73-his surfaces. These experiments were performed for numerous mAb pairs in both orders (mAb1 then mAb2 and mAb2 then mAb1) to establish the competition profiles and epitope bins (as summarized in Table 29 below).

As shown in Table 29, the epitope binning analysis revealed 2 epitope bins.

TABLE 29

| Antibody | Bin 1 | Bin 2 |
|----------|-------|-------|
| 7A11     | X     |       |
| 6E11     | X     |       |
| 11F11    | X     |       |
| 5F8      |       | X     |
| 4C3      |       | X     |
| 11A6     |       | X     |

The antibodies were also subjected to flow cytometry based cross-blocking. The experiment was conducted as follows using one set of labeled fluorescently labeled antibody and a second set of unlabeled antibody: 100000 NCI-H292 cells were seeded per well. The plate was spun down and the cells were resuspended in 100 uL 2% FBS in PBS per well. The cells were blocked on ice for 20 min. Unlabeled antibody, as indicated, in 2% FBS in PBS was added to each well. The plate was spun down and the cells were resuspended in 100 uL per well of diluted, labeled antibody (10 ug/mL), i.e., either 4C3 or 11F11, conjugated to FITC. 6 wells of cells were incubated without antibody, and were resuspended in 100 uL 2% FBS in PBS only (for controls). The cells were then incubated on ice for 30 min. The cells were washed twice with 2% FBS in PBS and the samples were resuspended in 140 uL 2% FBS in PBS, and analyzed on a FacsCalibur flow cytometer (Becton Dickinson).

The results of the flow cytometry-based cross-blocking, which are shown in FIGS. 26A and B, confirm the SPR epitope binning data set forth above. For example, 7A11 competes with 11F11, but 4C3 does not.

Example 9

Epitope Mapping by HDX

This Example describes the use of HDX-MS for the identification of the epitope on human CD73 to which CD73.4-IgG2CS-IgG1.1f.

Hydrogen/deuterium exchange mass spectrometry (HDX-MS) method probes protein conformation and conformational dynamics in solution by monitoring the rate and extent of deuterium exchange of protein backbone amide hydrogen atoms (except proline). The exchange level of HDX depends on protein solvent accessibility and hydrogen bonds, and the mass increase of the protein upon HDX can be precisely measured by MS. When this technique is paired with enzymatic digestion, structure features at the peptide level can be resolved, enabling differentiation of surface exposed peptides from those folded inside. In epitope mapping experiments, the deuterium labeling and subsequent quenching experiments are performed in parallel for antigen and antigen/mAb complex, followed by online pepsin digestion, peptide separation, and MS analysis.

Prior to epitope mapping of CD73.4-IgG2-CS-IgG1.1f in CD73 by HDX-MS, non-deuteriated experiments were performed to generate a list of common peptic peptides for recombinant human full length ECD dimeric CD73 (12 μM) and protein complex of recombinant human CD73 and CD73 mAb (1:1 molar ratio, 12 μM for CD73 mAb), achieving a sequence coverage of 88% for full length ECD CD73. In the HDX-MS experiment, 5 μL of CD73 (SEQ ID NO: 99) or CD73 with CD73.4-IgG2-CS-IgG1.1f mAb was diluted into 55 μL of D$_2$O buffer (10 mM phosphate buffer, D$_2$O, pD 7.0) to start the labeling reactions at room temperature. The CD73 protein used was glycosylated full length dimeric hCD73 having SEQ ID NO: 99, also shown below). The reactions were carried out for different periods of time: 20 sec, 1 min, 10 min and 240 min. By the end of each labeling reaction period, the reaction was quenched by adding quenching buffer (100 mM phosphate buffer with 4M GdnCl and 0.4M TCEP, pH 2.5, 1:1, v/v) and 50 μL of quenched sample was injected into Waters HDX-MS system for analysis. The deuterium uptake levels of common peptic peptides were monitored in the absence/presence of CD73 mAb.

The CD73 protein used had the amino acid sequence having SEQ ID NO: 99.

HDX-MS measurements on CD73 mAb in CD73 indicate that CD73.4-IgG2-CS-IgG1.1f mAb recognizes a discontinuous epitope comprised of two peptide regions in the N-terminal region of CD73:

```
Peptide region 1 (65-83):
FTKVQQIRRAEPNVLLLDA       (SEQ ID NO: 96)

Peptide region 2 (157-172):
LYLPYKVLPVGDEVVG          (SEQ ID NO: 97)
```

Figure 27A:
FIG. 27A shows the amino acid sequence (SEQ ID NO: 283) of human CD73 and the regions of interaction with CD73.4-IgG2CS-IgG1.1f, which are represented in a darker grey. The stronger the interaction, the darker the grey.
Figure 27B:
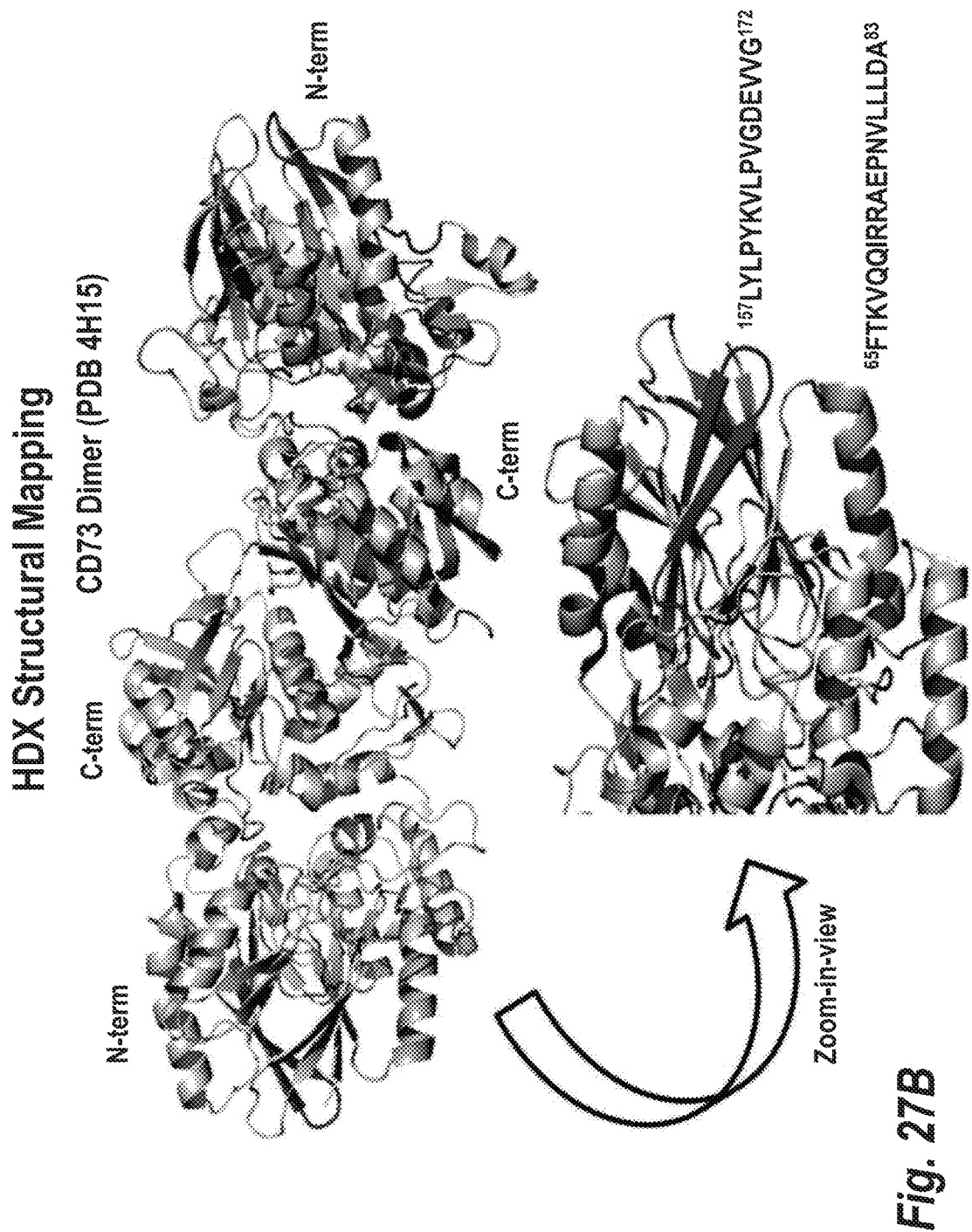
FIG. 27B shows a model of the interaction between a dimeric human CD73 protein and CD73.4-IgG2CS-IgG1.1f.

A three-dimensional view of the interaction (FIG. 27B) shows that these two regions are geometrically close. A detailed map of the interaction is shown in FIG. 27A.

Example 10

Crystal Structure of 11F11 Binding to CD73

This Example describes the crystal structure of a Fab' of 11F11 bound to CD73(26-336)His.

CD73(26-336)His was purified from transiently transfected HEK-293 E cells using standard protocols, and used as such, or was deglycosylated by PNGase F treatment, and concentrated to 1.2 mg/ml. Antibody 11F11 Fab' was prepared by Pepsin digestion of 11F11 using standard protocols, and concentrated to 1.1 mg/ml.

The complex was formed by incubating equal volumes of deglycosylated hCD73(26-336)His and the 11F11 Fab' overnight at 4° C., purified by using GE Superdex 200 26/60 column, and concentrated to 9.5 mg/ml using a 10k MWCO spin concentrator.

The crystals were grown in sitting drops, vapor diffusion experiments and the drop was 0.25 uL protein mixed with 0.25 uL reservoir solution. Over 7100 crystallization experiments were set up. Initial crystal leads were small about 10 μm. Optimized crystals were 200-300 μm in size. Crystallization optimization included screening: additives, detergents, precipitants, pH, temperature, and buffer type. The conditions that allowed crystal formation were as follows: the reservoir solution consisted of 34% Polypropylene Glycol P400, 0.1 M Na/K PO4 pH 6.5, and 15 μM CYMAL-7; crystallization experiments setup at room temperature and then placed at 4° C. to incubate; and incubation at 4° C. for 7 days. Crystal formation was only observed with the glycosylated CD73 protein.

The crystals were harvested directly from the crystallization drop and placed directly into liquid N2. Over 100 crystals were screened for diffraction in-house.

Data were collected using a small beam, very little attenuation, and helical data collection on SER-CAT beamline 22ID with the Rayonix MX-33HS high speed CCD detector. Data sets were collected at 4.1 Å, 3.8 Å, 3.5 Å, and finally at 3.05 Å. The data, processed and scaled using routine HKL2000 (Otwinowski Z., Minor W., Methods in Enzymology 276, 307-326 (1997)), was 96% complete to 3.04 Å resolution.

A BLAST (Altschul et al. (1990) "Basic local alignment search tool." J. Mol. Biol. 215:403-410) search was used to find the closest model for the CD73 N-terminal domain and the Fc and Fv domains in the RCSB Protein Data Bank to be used in a molecular replacement search: CD73 model was from PDB entry 4H1S (Heuts et al. Chembiochem. 2012 Nov. 5; 13(16):2384-91).

These were used as the starting model in the PHASER (McCoy et al. J. Appl. Cryst. (2007). 40, 658-674) molecular replacement search. The CD73 search found 5 molecules in the asymmetric unit. Keeping the CD73 fixed, a search with the heavy chain search model found 2 molecules in the asymmetric unit. Keeping the CD73s and heavy chains fixed, a third PHASER search with the light chain also found 2 molecules in the asymmetric unit. A composite model of five complete complexes was made from the partial solutions by overlaying the five CD73s and matching up the heavy and light chains. This was used as the starting model for a BUSTER (Bricogne et al. (2011) BUSTER version 2.11.6. Cambridge, United Kingdom: Global Phasing Ltd) refinement.

The model has been refitted and the amino acids changed to reflect the 11F11 sequences. The model underwent extensive manual model-building and refinement. A total of five BUSTER refinement cycles were run to complete the refinement. The final R-factor is 20.59% (R-free=24.58%) for the 27,484 protein atoms and 24 solvent molecules.

Representations of the crystal structure of the complex are set forth in FIGS. 28A-D.

Figure 28A:
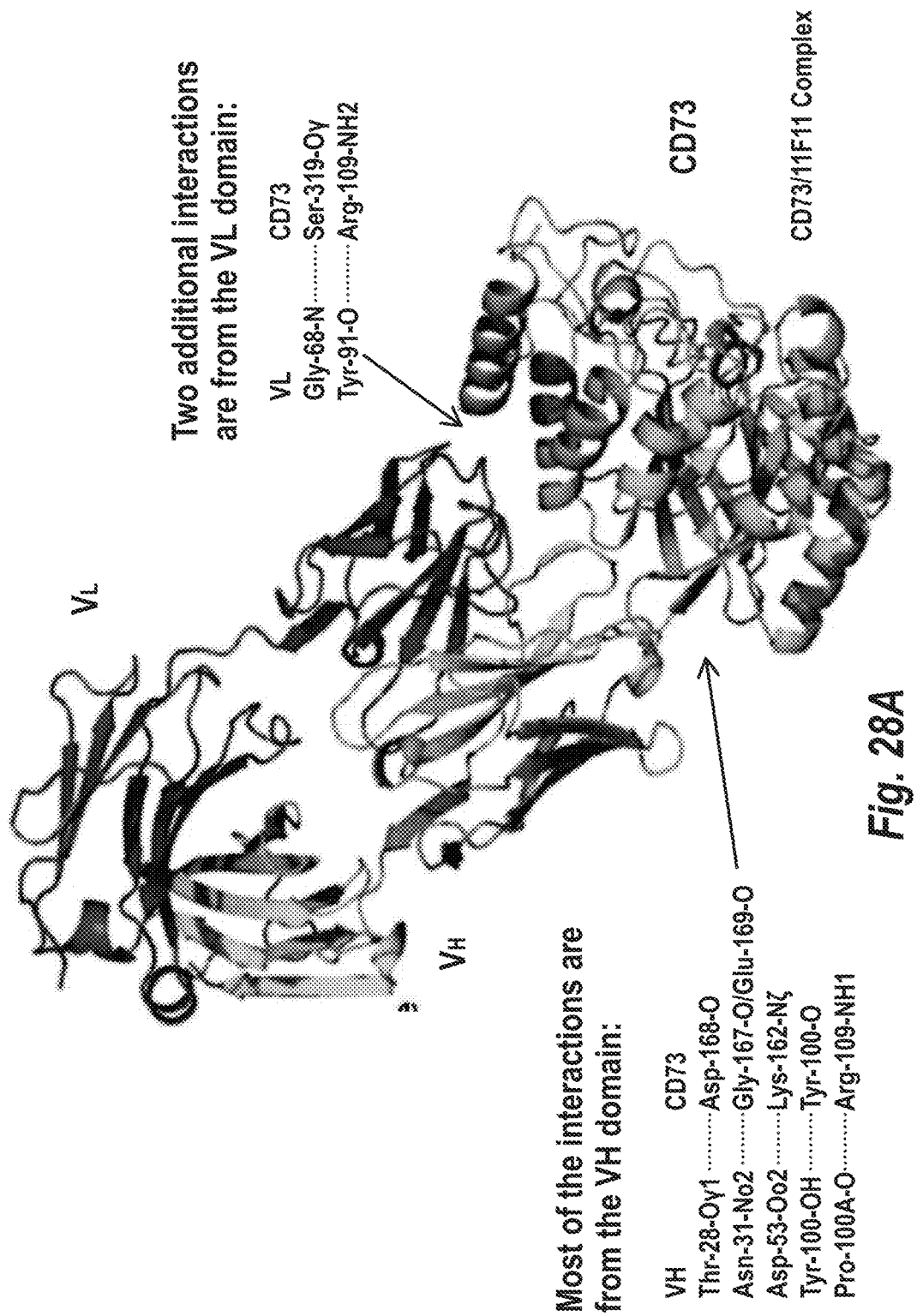
FIG. 28A shows a crystallographic model of the interaction between human CD73 and 11F11Fab' fragment.
Figure 28B:
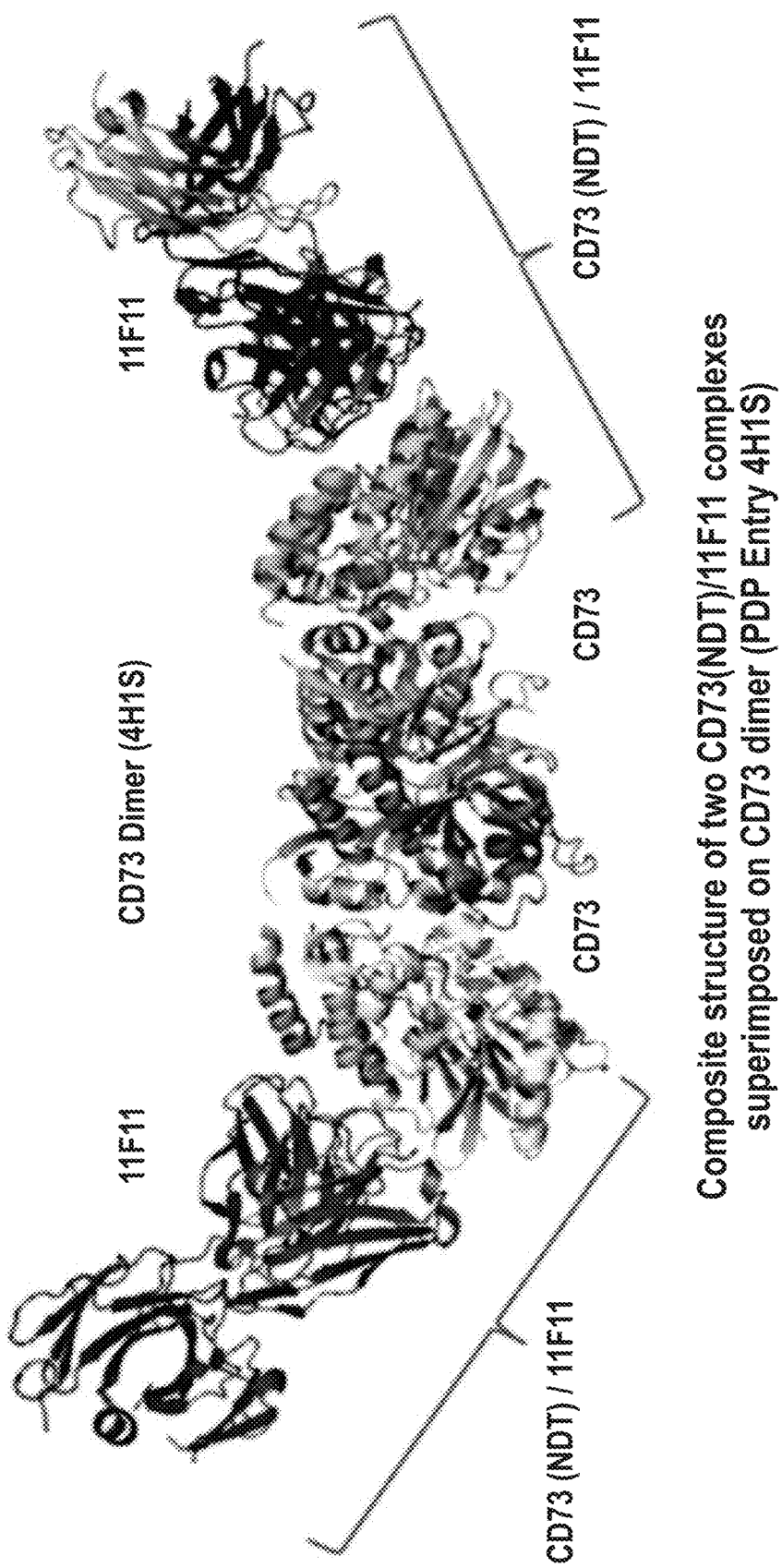
FIG. 28B shows a model of a composite structure of two human CD73 complexes with 11F11.
Figure 28C:
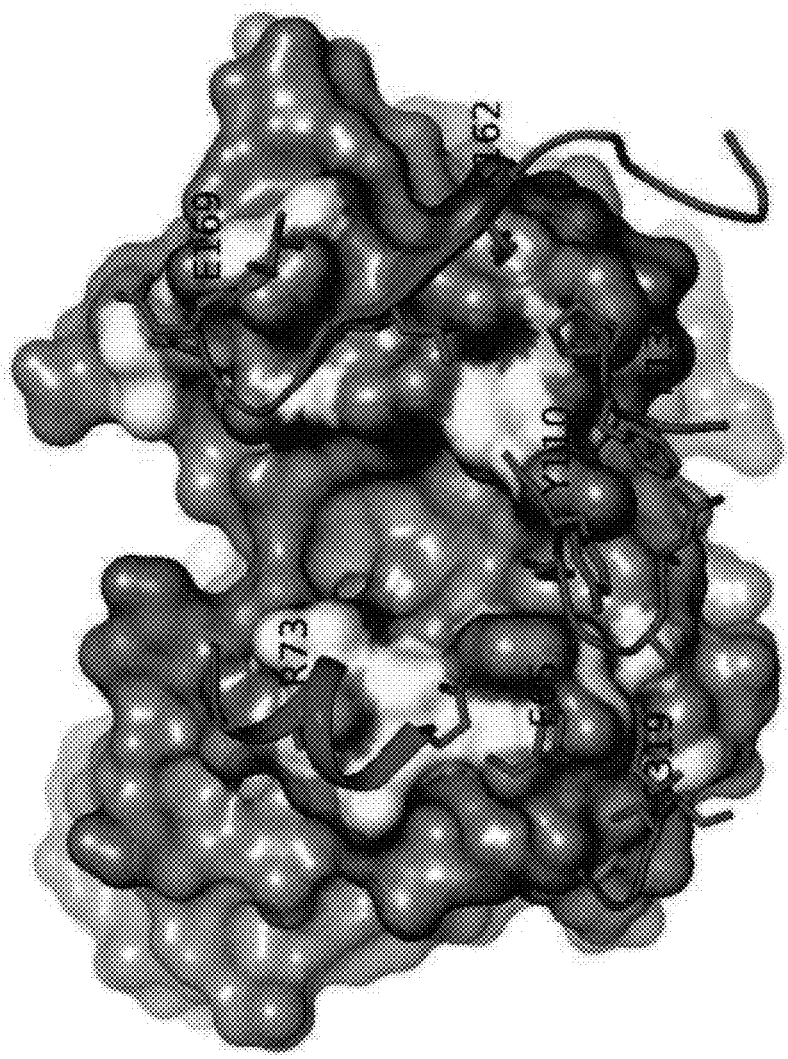
FIG. 28C shows a model of the interaction between human CD73 and 11F11 antibody.
Figure 28D:
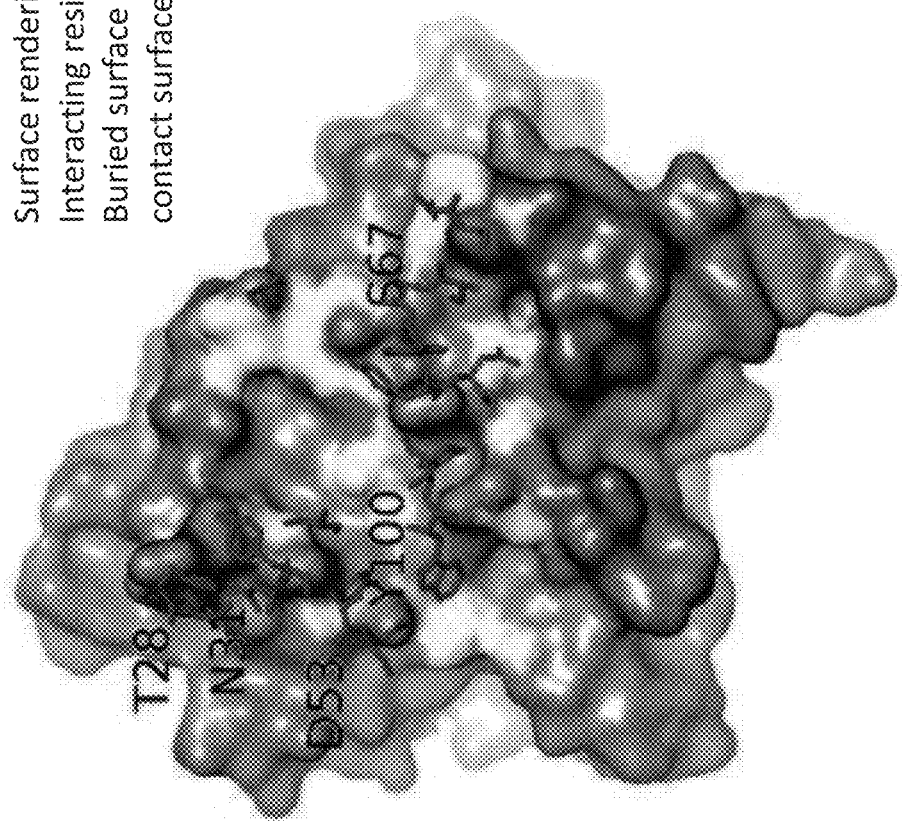
FIG. 28D shows a model of the interaction between 11F11 and human CD73.

The crystal structure shows that all but one of the interactions are from residues in the CDR regions, and that most of the interactions are from the VH domain with two additional interactions from the VL domain (FIG. 28A). The interacting residues of human CD73 and 11F11 Fab' are shown in Table 30.

TABLE 30

| CD73 Residue | Interaction | 11F11 Heavy Chain Residue | Distance (Å) | 11F11 Light Chain Residue | Distance (Å) |
|---|---|---|---|---|---|
| Phe-65 | VDW | | | Ser-30 | 4.0 |
| | | | | Ser-31 | 3.5 |
| | | | | Trp-32 | 3.8 |
| Gln-69 | VDW | | | Trp-32 | 3.9 |
| Arg-73 | VDW | | | Ser-53 | 3.8 |
| Asn-106 | VDW | Tyr-100 | 3.6 | | |
| Ala-107 | | | | Trp-32 | 3.7 |
| Arg-109 | H-Bond | Pro-100A | 2.8 | Tyr-91 | 3.0 |
| | VDW | Tyr-100 | 3.4 | Trp-32 | 3.5 |
| | | | | Asn-92 | 3.5 |
| Tyr-100 | H-Bond | Tyr-100 | 3.0 | | |
| Lys-136 | VDW | Trp-99 | 3.3 | | |
| | | Tyr-100 | 3.6 | | |
| Phe-137 | VDW | Trp-99 | 3.6 | | |
| | | Tyr-100 | 3.3 | | |
| Pro-138 | VDW | Trp-99 | 3.4 | | |
| Lys-162 | Salt Link | Asp-53 | 2.8 | | |
| | VDW | Tyr-52A | 3.2 | | |
| | | Trp-99 | 3.8 | | |
| Leu-164 | VDW | Tyr-52A | 3.6 | | |
| Pro-165 | VDW | Asn-31 | 3.2 | | |
| | | Tyr-52A | 3.6 | | |
| | | Ser-97 | 3.5 | | |
| Gly-167 | H-Bond | Asn-31 | 2.7 | | |
| | VDW | Tyr-32 | 3.7 | | |
| Asp-168 | H-Bond | Thr-28 | 2.9 | | |
| | VDW | Asn-31 | 3.3 | | |
| | | Phe-27 | 3.4 | | |
| Glu-169 | H-Bond | Asn-31 | 2.9 | | |
| Val-170 | VDW | Asn-31 | 3.5 | | |
| Ser-319 | H-Bond | | | Ser-67 | 2.7 |
| | | | | Gly-68 | 3.0 |
| | VDW | | | Ser-30 | 3.8 |
| | | | | Ser-67 | 3.8 |
| Ile-320 | VDW | | | Ser-30 | 4.0 |

A model based on the composite structure of two CD73 (NDT)/11F11 complexes superimposed on CD73 dimer (PDB Entry 4H1S) suggests that 11F11 binds to the surface on CD73 away from the dimer interface, suggesting that the Fab would not interfere with dimer formation.

A comparison of HDX-MS mapping and the X-ray results on the CD73/11F11 complex shows that they are in basic agreement showing a similar epitope on CD73 (65-83 and 157-172). However, the X-ray structure shows additional interactions (less than 6Å) in the region of Met-105 to Asp-111 (including H-bonds to Arg-109 and Tyr-110), Lys-135 to Pro-139, and Asp-317 to Ile-320 (including H-bonds to Ser-319).

Example 11

Impact of Different Hinge/Fcs on Size of Antibody/CD73 Complexes

As shown in the above Examples, anti-CD73 antibodies with an IgG2 hinge and CH1 are better inhibitors of CD73 enzymatic activity on cells and internalize better than the same antibodies with an IgG1 hinge. Based on this observation, and the fact that an IgG2 hinge is stiffer than an IgG1 hinge, it was hypothesized that larger complexes are formed between an antigen and antibodies having an IgG2 hinge relative to antibodies having an IgG1 hinge. The following experiment was conducted to analyze this hypothesis.

The structure and oligomeric state of CD73/antibody complexes in solution were examined by SEC-MALS and DLS. For these studies, antibodies containing either an IgG1 or IgG2 constant region, were mixed at varying molar ratios with recombinant proteins comprising either the full length extracellular domain of human-CD73 containing a C-terminal polyhistidine tag (amino acid residues 26-546 of human-CD73, termed "hCD73-his") or a fragment corresponding to the N-terminal domain of human-CD73 (amino acid residues 26-336, termed "N-hCD73-his").

The oligomeric state of CD73/antibody complexes were examined by size-exclusion chromatography coupled to an in-line multi-angle light scattering detector (SEC-MALS). Isocratic separations were performed on a Shodex PROTEIN KW-803 column connected to an Prominence Shimadzu UFLC in buffer containing 200 mM $K_2HPO_4$, 150 mM NaCl, pH 6.8, containing 0.02% Na azide (0.1 µm filtered) running at 0.5 mL/min. Samples were injected onto the column using a SIL-20AC Prominence Shimadzu autosampler, and data were obtained from three online detectors connected in series: a Prominence SPD-20AD diode array UV/vis spectrophotometer followed by a Wyatt miniDAWN™ TREOS Multi-Angle Light Scattering Detector then a Wyatt Optilab T-rEX Refractive Index Detector. Data were collected and analyzed using Astra (Wyatt) and Labsolutions (Shimadzu) software.

Dynamic light scattering (DLS) studies were performed on a Wyatt DynaPro plate reader in 384 well plates at 25° C. Experimental parameters were 20 acquisitions of 5 s each per measurement, and measurements were recorded in quadruplicate, with the average and standard deviation reported. Intensity autocorrelation functions were fitted using the "Regularization" algorithm in the Dynamics software (Wyatt Technologies).

A summary of the SEC-MALS and DLS is provided in FIGS. 29A and B. Analysis of the antibodies alone, shows retention times (about 16-17 min), masses (140-150 kDa), and hydrodynamic radii (5.0-5.4 nm) for each antibody that are typical for a monomeric monoclonal antibody. The data for the hCD73-his protein is consistent with the protein adopting the expected dimeric structure in solution; in particular, the mass determined from the SEC-MALS data (120 kDa) is consistent with that expected for a CD73-his dimer (117 kDa) and inconsistent with what would be expected for a hCD73-his monomer (58.5 kDa). The data for N-hCD73 is consistent with the recombinant N-domain protein being monomeric in solution (SEC-MALS measured mass=38 kDa, compared to expected monomeric mass=35.0 kDa), which is expected because the region of the full length CD73 extracellular domain that is responsible for dimerization of the protein is contained within the C-terminal domain without contribution of N-domain residues.

Equimolar mixtures of a given antibody with N-hCD73-his were found to elute as a single species in the SEC with shorter retention time than the antibody or N-hCD73-his alone, as well as larger hydrodynamic radii (Rh) by DLS, which is consistent with the formation of complexes. MALS data indicate masses for these complexes of approximately 210 kDa. This is consistent with one N-hCD73-his molecule bound to each of the two Fab domains of a given antibody to form a 1:2 antibody:N-hCD73-his complex.

Figure 30E:
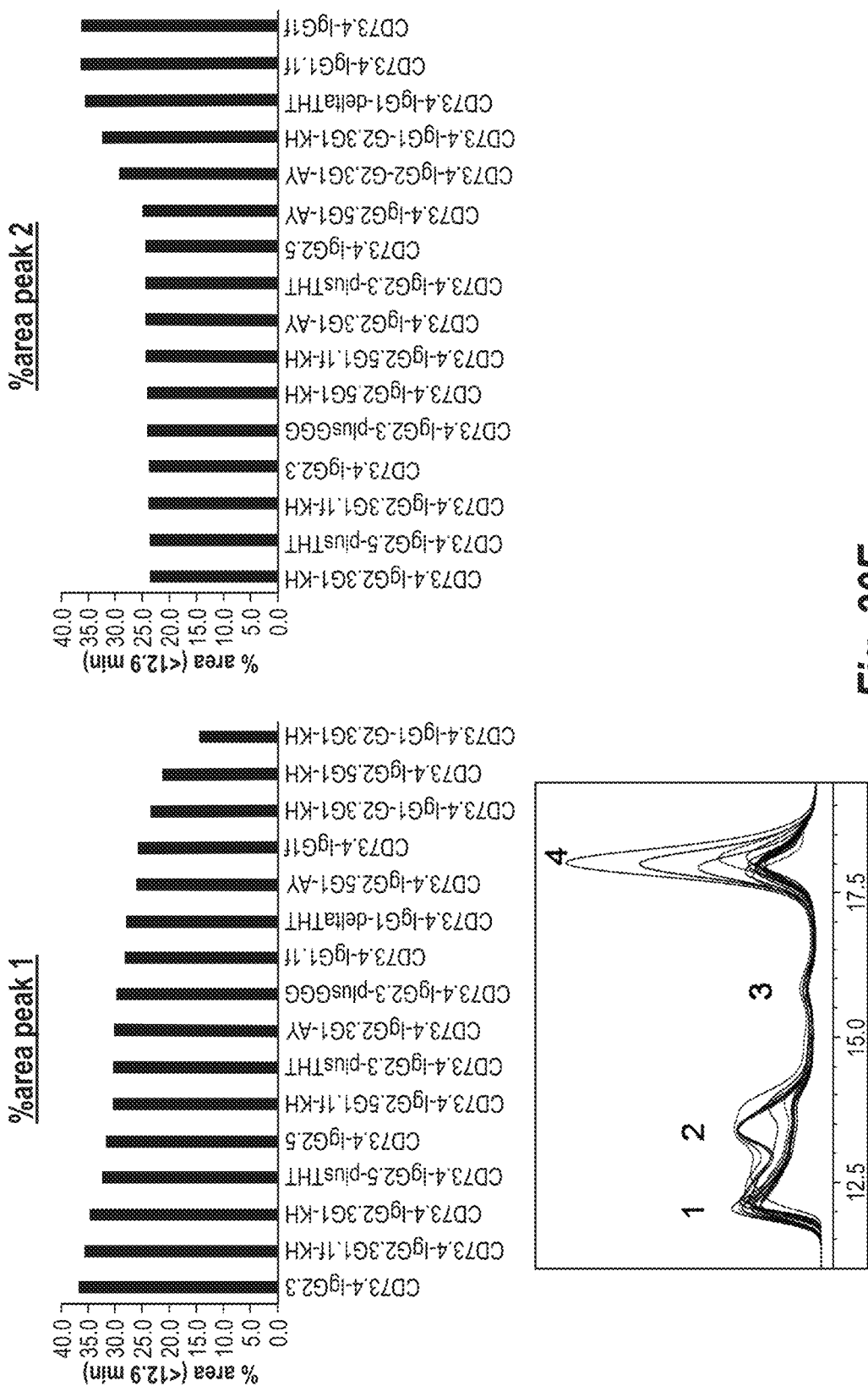
FIG. 30E shows that higher order complexes are impacted by the CH1 region. The histograms show the % area under peaks 1 and 2, shown in the graph, for each construct.

SEC-MALS data for mixtures of anti-CD73 antibodies with hCD73-his dimer shows that the mixture elutes earlier than either the hCD73-his or antibody alone, suggesting that complexes are formed. Comparing the data for mAbs that contain the same variable region but different constant domains, shows that the elution times for the complexes of hCD73-his with mAbs containing a IgG2 constant domains (IgG2-C219S, IgG2-C219S-IgG1.1f) are earlier than those for complexes of hCD73-his with mAbs containing an IgG1.1f constant domain. In addition, the MALS-determined masses for complexes of hCD73-his with mAbs containing an IgG2 constant domain are larger than those for complexes of hCD73-his with mAbs containing an IgG1 constant domain. DLS data further shows that the hydrodynamic radius of complexes of hCD73-his with mAbs containing a IgG2 constant domain are larger than those for complexes of hCD73-his with mAbs containing an IgG1 constant domain. For example, the SEC-MALS and DLS data for CD73.4 with three different constant regions (IgG2-C219S, IgG2-C219S-IgG1.1f, or IgG1.1f) is shown in FIG. 30. Here it can be seen that the complex of hCD73-his with CD73.4 containing the IgG2 constant domain have shorter retention times (FIG. 30A), larger hydrodynamic radii (FIG. 30B) and larger MALS-determined masses (FIG. 30C), as compared to the complexes of hCD73-his with CD73.4-IgG1.1f. Based on the MALS masses, a schematic model for the structure and stoichiometry of the complexes between hCD73-his and the antibodies is shown in FIG. 30D, where complexes containing CD73.4-IgG1.1f predominantly form smaller 2:2 (peak 1=~550 kDa) or 4:4 mAb/CD73 dimer complexes (peak 2=~1300 kDa), whereas CD73.4-IgG2-C219S or CD73.4-IgG2-C219S-IgG1.1f form much larger complexes (>3000 kDa) with hCD73-his, for which precise structure and stoichiometry cannot be confidently modeled.

CD73.4 antibodies having the heavy chain constant regions set forth in Table 26 were also tested for size of complex formation. As shown in FIG. 30D, the results indicate that higher order complexes are formed with antibodies having an IgG2 CH1 domain relative to those having an IgG1 CH1 domain.

Collectively the SEC-MALS and DLS data demonstrate that larger complexes are formed between hCD73-his and mAbs containing an IgG2 hinge and CH1 region (IgG2-C219S or IgG2-C219S-IgG1.1f), compared to those containing the IgG1 hinge and CH1 region (IgG1.1f). In addition, antibodies having an IgG2 CH1 domain form larger complexes that those having an IgG1 CH1 domain.

Example 12

Relevance of Certain Amino Acid Residues in IgG2 CH1 and Hinge in Improving Antibody Mediated CD73 Internalization Anti-CD73 antibodies (CD73.4) with the heavy chain constant regions shown in Table 31 were prepared and tested as described above in antibody mediated CD73 internalization assays.

TABLE 31

Heavy chain constant regions that were fused to anti-CD73 variable regions

| Description | Constructs | SEQ ID NO of constant region |
|---|---|---|
| CH1 domain of IgG2, with all else IgG1. Also, Cys > Ser mutant to reduce potential disulfide heterogeneity: | G2-G1-G1-G1 | 300 |
| | G2.5-G1-G1-G1 | 301 |
| CH1 domain of IgG1 with all else IgG2.3: | G1-G2.3-G2-G2 | 302 |
| Swap CH1 regions in IgG1 with those of IgG2, either separate or together | G1-KRGEGSSNLF | 303 |
| | G1-KRGEGS | 304 |
| | G1-SNLF | 305 |
| | IgG1-ITNDRTPR | 306 |
| | G1-SNLFPR | 307 |
| Swap CH1 regions in IgG2 with those of IgG1, either separate or together: | G2-RKEGSGNSFL | 308 |
| | G2-RKEGSG | 309 |
| | G2-NSFL | 310 |
| | IgG2-TIDNTRRP | 311 |
| | G2-NSFLRP | 312 |
| IgG1 with CH2 domain residues of IgG2: | G1-G1-G2-G1-AY | 313 |
| | G1-G1-G2-G1-KH | 314 |
| IgG2 with CH2 domain residues of IgG1: | G2-G2.3-G1-G2-KH | 315 |
| | G2.5-G2.3-G1-G2-KH | 316 |
| | G2.3-G1-G2-AY | 317 |
| | G2.5-G2.3-G1-G2-AY | 318 |
| Swap hinge regions between IgG1 and IgG2: | G1-G2.3-G1-G1-KH | 319 |
| | G2-G1-G2-G2-AY | 320 |
| | G2.5-G1-G2-G2-AY | 321 |
| | G1-G2-G1-G1-AY | 322 |

TABLE 31-continued

Heavy chain constant regions that were fused to anti-CD73 variable regions

| Description | Constructs | SEQ ID NO of constant region |
|---|---|---|
| | G2-G1-G2-G2-KH | 323 |
| | G2.5-G1-G2-G2-KH | 324 |
| Hinge truncations | IgG1 - deltaHinge | 325 |
| | IgG2 - deltaHinge | 326 |
| | IgG2.5 - deltaHinge | 327 |
| | IgG1 - deltaG237 | 328 |
| | IgG2 - plusG237 | 329 |
| Other | IgG2.4 | 330 |
| | IgG2.3/4 | 331 |

Figure 31:
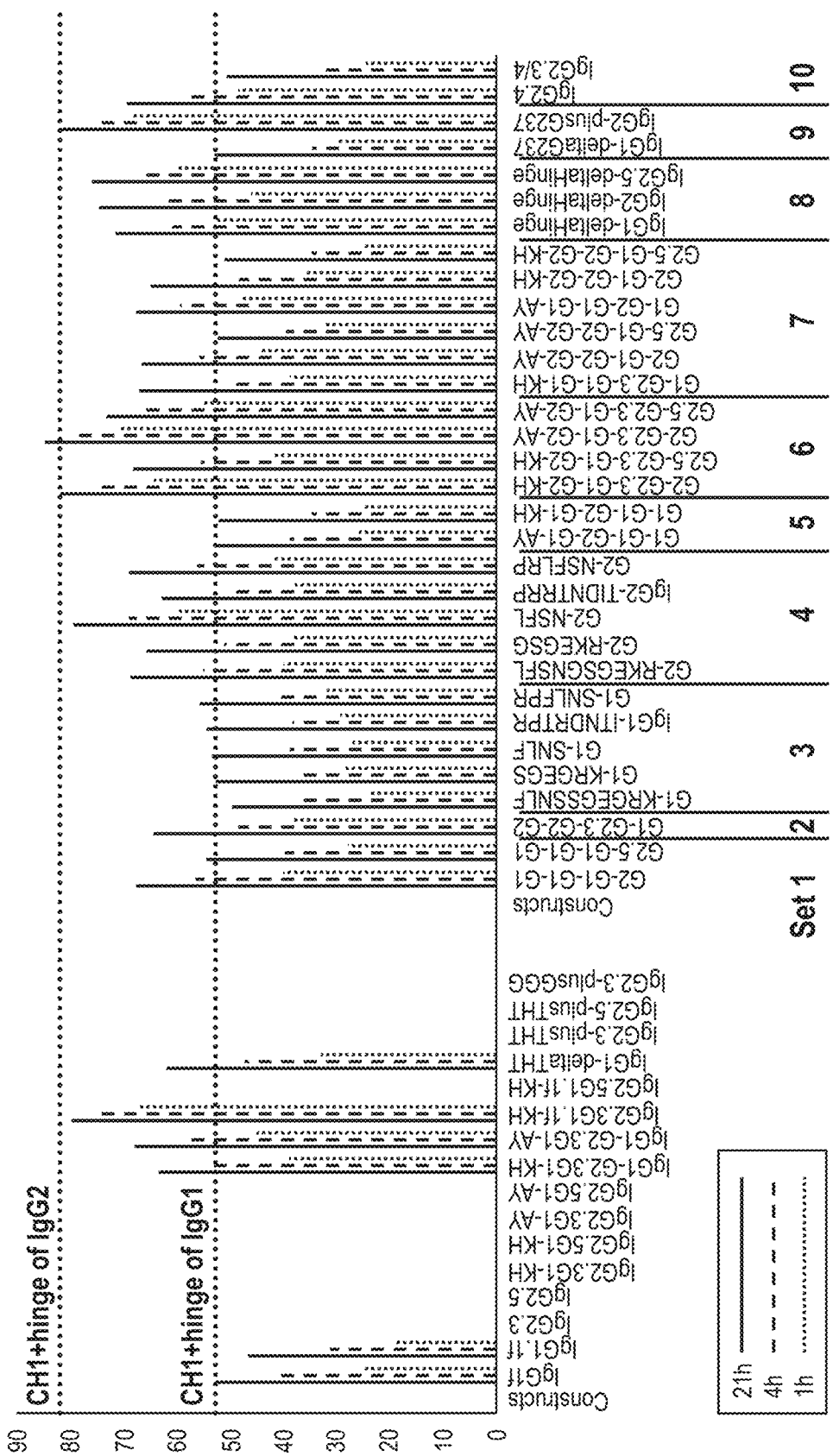
FIG. 31 shows the percentage of antibody mediated CD73 internalization at 1, 4 or 21 hours after the addition of each of the shown antibodies. The bars for each antibody are shown in the order of 21 hours (on the left), 4 hours (middle) and 1 hour (right).

The results, which are shown in FIG. 31, provide the following information in the context of CD73 internalization:
CH2 domain does not appear to have an impact as shown by
  a) very little difference in internalization ability was observed between the antibodies comprising a modified heavy chain constant region with format "AY" (having the IgG2 hinge ERKCCVECPPCPAPPVAG (SEQ ID NO: 8) relative to those with format "KH" (ERKCCVECPPCPAPELLGG (SEQ ID NO: 22) (Set 5, 6 and 7);
  b) CH2 swaps are comparable to wiltype G1 or G2 (Sets 5 and 6); and
  c) residue 237 has no impact on internalization: neither the addition of a "G" residue to an IgG2 hinge nor the deletion of the C terminal "G" in an IgG1 hinge affected internalization (Set 9).
This suggests that the CH2 domain does not impact internalization (i.e., the CH2 domain can be from IgG1 or IgG2);
Swapping the CH1 regions indicated in Set 3 (KRGEGSSNLF; KRGEGS; SNLF; ITNDRTPR and SNLFPR) in IgG1 with those of IgG2 provides little benefit, i.e., the internalization remains similar to that of IgG1; see Set 3);
Swapping the CH1 regions indicated in Set 4 (RKEGSGNSFL; RKEGSG; NSFL; TIDNTRRP and NSFLRP) in IgG2 with those of IgG1 has variable impact: changing NSFL has no impact, whereas the other 2 regions (RKEGSG & RP) are involved (see Set 4). Based on the results of Sets 3 and 4, it appears that there is an interaction between the CH1 region and the hinge, with RKEGSG and RP regions being more important than NSFL region;
The hinge region impacts internalization, i.e., the hinge of IgG2 provides better internalization relative to the hinge of IgG1 (see Sets 7 and 8). In addition, IgG1 with a deletion (G1-delta-hinge) improves internalization over IgG1. IgG2 with a deletion (G2-delta-hinge) provides a similar level of internalization relative to that of an IgG2 hinge. This suggests that the hinge region impacts internalization, which effect is enhanced by an IgG2 CH1 (G2-G1-G2-G2-AY is comparable to G1-G2-G1-G1-AY);
IgG2.4 (C220S) has similar or reduced internalization compared to IgG2.3 (C219S). IgG2.3/4 (C219S/C220S) has much reduced internalization compared to IgG2.3 or IgG2.4 alone (see Set 10). This suggests that internalization of an antibody with an IgG2 hinge and C219S is about the same as that of an IgG2 hinge with C220S, both of which are much better than that of an IgG2 hinge with both C219S and C220S;
IgG2.5 (C131S mutation) has reduced internalization compared to constructs with C131 (see Sets 1, 6 and 7).
Thus, these results indicate that the CH1 domain and the hinge are both relevant in the antibody mediated CD73 internalization, and that an antibody having the IgG2 sequences from these domains is internalized with better efficacy relative to an antibody having these regions from IgG1.

Example 13

Antibodies Having an IgG2 Hinge and/or CH1 Domain Form High Molecular Weight Complexes CD73.4 antibodies having the heavy chain constant regions set forth in Table 26 were also tested for formation of high molecular weight complexes by SEC-MALS and DLS experiments, as described in Example 11.

Figure 32A:
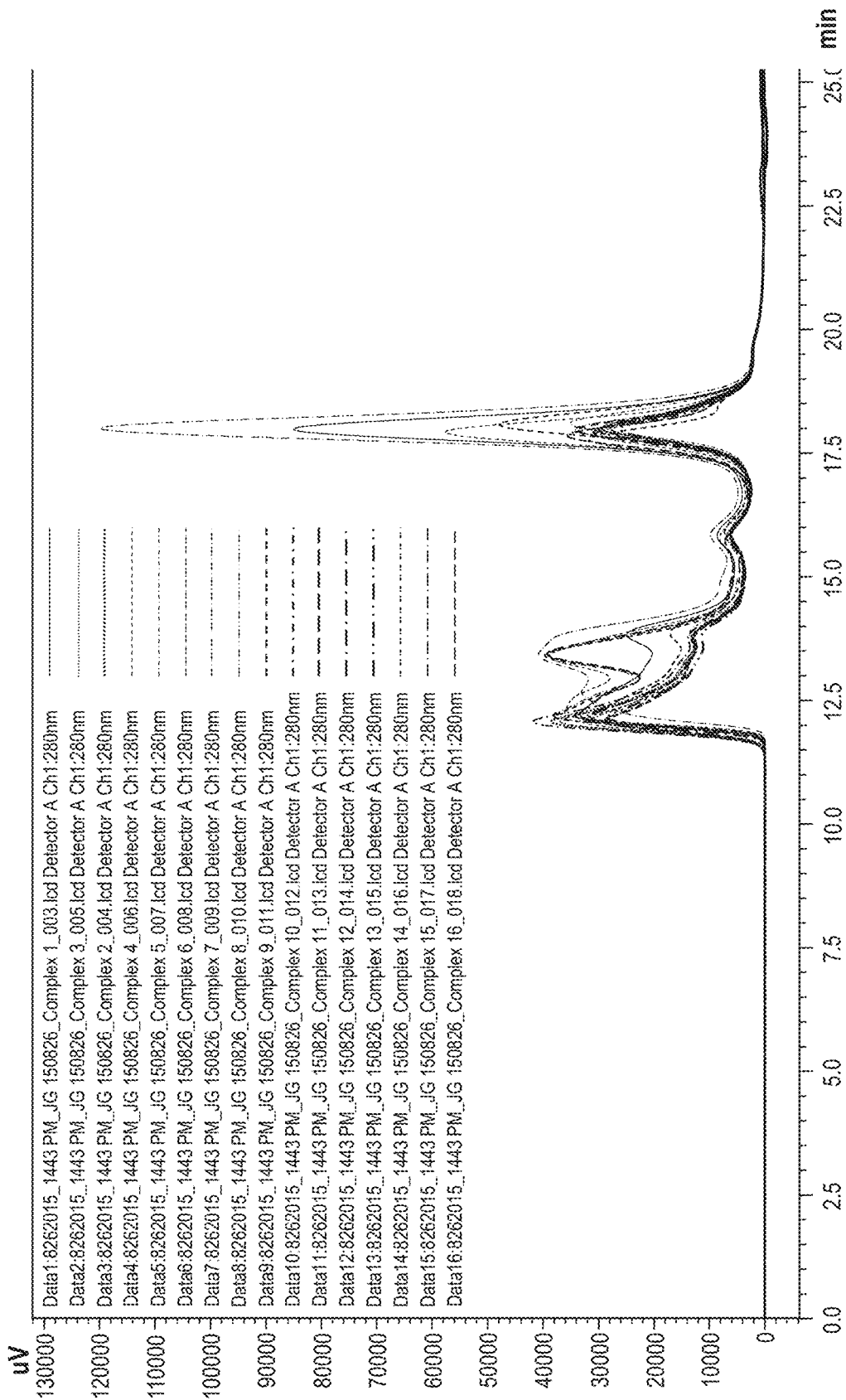
FIG. 32A shows an overlay of SEC chromatogram data for 1:1 molar complexes of hCD73-his with 16 different CD73.4 antibodies containing different constant region sequences.
Figure 32B:
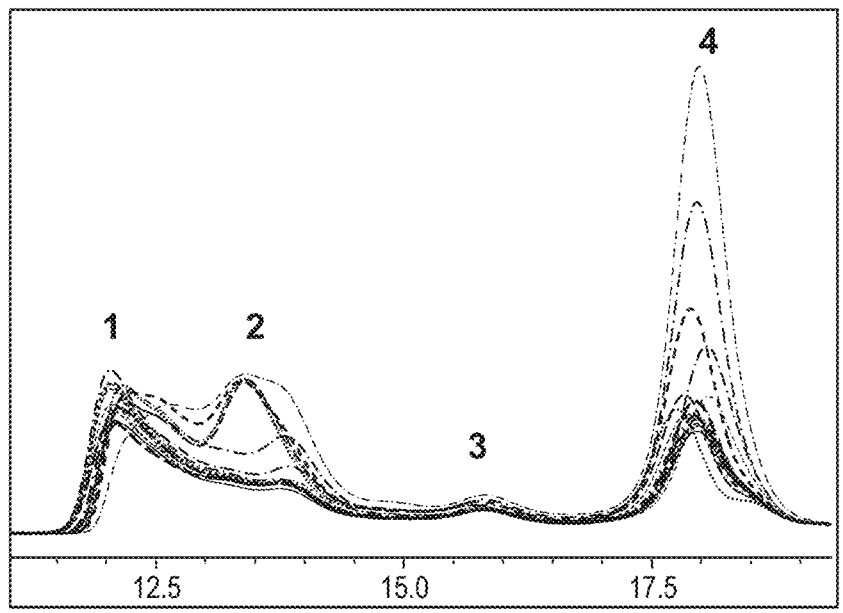
FIG. 32B shows an expansion of the chromatogram data from 11-19.5 min of the chromatogram of FIG. 32A, with 4 distinct elution species indicated.
Figure 32C:
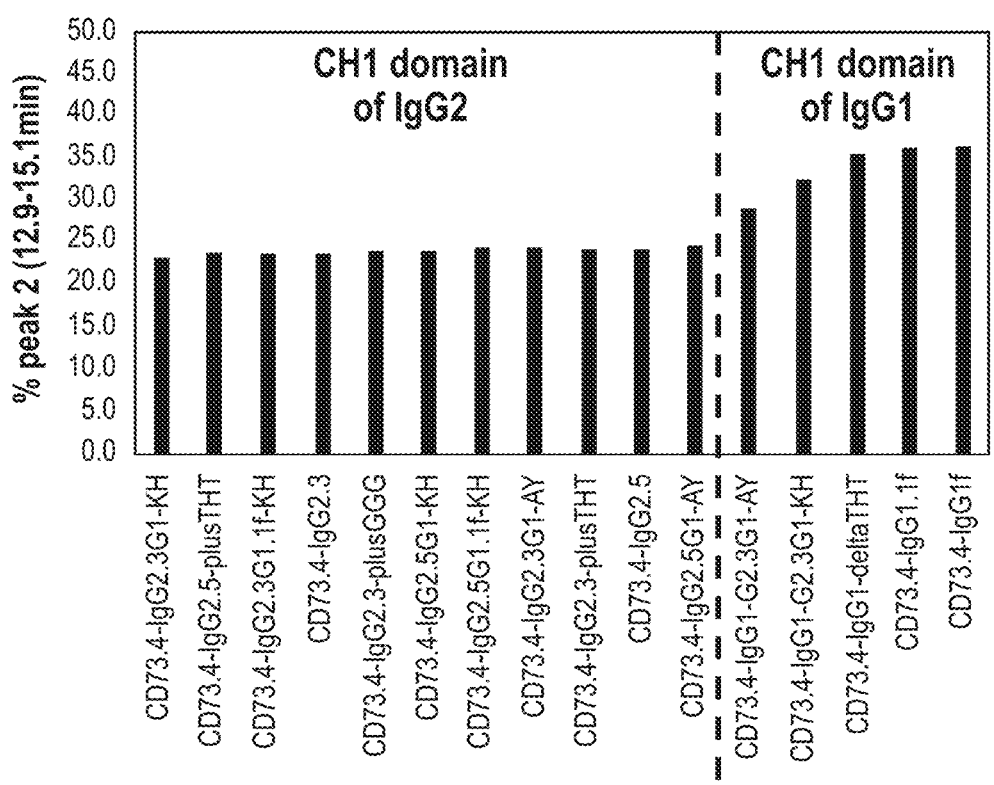
FIG. 32C shows the percentage of the UV chromatogram signal area for peak 2 of FIG. 32B, plotted for the 16 different antibody/CD73-his complexes. Data is sorted from left to right in order of increasing peak area.

Three out of the 16 antibodies in this study were were previously tested: CD73.4-IgG1.1f, CD73.4-IgG2-C219S (also called CD73.4-IgG2.3), and CD73.4-IgG2-C219S-IgG1.1f (also called CD73.4-IgG2.3G1.1f-KH). SEC-MALS and DLS data of the antibodies alone showed retention times, masses, and hydrodynamic radii for each antibody that are typical for a monomeric monoclonal antibody. Equimolar complexes of each antibody (5.5 uM) with hCD73-his (5.5 uM) showed slower retention times for all complexes as compared to antibody or hCD73-his alone indicating the formation of complexes. An overlay of the SEC chromatogram data for each of the 16 complexes is shown in FIG. 32A. The chromatogram data can be divided into 4 distinct peaks, which are shown in FIG. 32B. Peak 1 contains the largest species, with MALS-determined masses suggesting complexes with mass equivalent of greater than 4:4 hCD73-his:mAb complexes. Peak 2 contains species with MALS-determined masses suggesting complexes of about 2:2 hCD73-his:mAb complexes. Peak 3 is a minor species with low signal and MALS-determined masses suggesting about 1:1 hCD73-his:mAb complexes. Peak 4 corresponds to the elution of the mAbs alone with MALS-determined masses consistent with free antibody. To quantitate the relative amounts of each species, the 4 peaks of each chromatogram were integrated as peak 1 (<12.9 min), peak 2 (12.9-15.1 min), peak 3 (15.1-16.7 min), peak 4 (16.7-19.3 min). The integration also included an additional integrated range called peak 5 (>19.3 min) to account for any low molecular weight species, which were found to be negligible (<3.5% for all complexes). The percentage of each species from this integration is summarized in Table 32. All complexes contained a similar small percentage of peak 3 (about 6-9%), but variable amounts of the other peaks. Most notable is that all complexes between hCD73-his and antibodies containing a CH1 domain from hIgG1 had a significantly greater percentage of smaller complexes (peak 2), whereas those containing CH1 domain from hIgG2 had a greater percentage of larger complexes (peak 1) (Table 32 and FIG. 32C). This suggests an important role for not only the hinge region but also the CH1 domain in higher order complex formation.

TABLE 32

Retention times of CD73.4 antibodies with modified heavy chain constant regions

| | UV % | | | | |
|---|---|---|---|---|---|
| Complexes | Peak1 <12.9 min | Peak2 12.9-15.1 min | Peak3 15.1-16.7 min | Peak4 16.7-19.3 min | Peak5 >19.3 min |
| CD73.4-IgG2.3 + hCD73-his | 37.0 | 23.8 | 7.7 | 28.6 | 2.9 |
| CD73.4-IgG2.3G1.1f-KH + hCD73-his | 36.0 | 23.8 | 7.9 | 29.3 | 3.0 |
| CD73.4-IgG1.1f + hCD73-his | 28.4 | 36.2 | 7.4 | 25.6 | 2.3 |
| CD73.4-IgG1f + hCD73-his | 26.0 | 36.5 | 7.5 | 27.8 | 2.2 |
| CD73.4-IgG2.3G1-AY + hCD73-his | 30.2 | 24.3 | 8.1 | 34.4 | 3.0 |
| CD73.4-IgG2.3G1-KH + hCD73-his | 34.9 | 23.4 | 7.9 | 30.7 | 3.0 |
| CD73.4-IgG1-G2.3G1-AY + hCD73-his | 14.6 | 29.2 | 6.4 | 48.3 | 1.6 |
| CD73.4-IgG1-G2.3G1-KH + hCD73-his | 23.8 | 32.6 | 7.0 | 34.5 | 2.1 |
| CD73.4-IgG1-deltaTHT + hCD73-his | 28.3 | 35.4 | 7.0 | 26.9 | 2.4 |
| CD73.4-IgG2.3-plusTHT + hCD73-his | 30.6 | 24.3 | 8.3 | 33.7 | 3.2 |
| CD73.4-IgG2.3-plusGGG + hCD73-his | 30.0 | 23.9 | 8.2 | 34.9 | 2.9 |
| CD73.4-IgG2.5 + hCD73-his | 31.7 | 24.4 | 8.4 | 32.5 | 3.1 |
| CD73.4-IgG2.5G1.1f-KH + hCD73-his | 30.7 | 24.3 | 8.9 | 32.7 | 3.4 |
| CD73.4-IgG2.5G1-AY + hCD73-his | 26.3 | 24.8 | 8.1 | 38.3 | 2.6 |
| CD73.4-IgG2.5G1-KH + hCD73-his | 21.4 | 24.1 | 7.0 | 45.6 | 1.9 |
| CD73.4-IgG2.5-plusTHT + hCD73-his | 32.6 | 23.5 | 8.3 | 32.6 | 3.0 |

Example 14

Fc Receptor Binding for Antibodies with Engineered Constant Domains

This Example demonstrates that antibodies having modified heavy chain constant regions comprising the CH1 and hinge of IgG2 bind to FcγRs when they contain CH2 and CH3 domains of IgG1.

In addition to antigen binding by the variable domains, antibodies can engage Fc-gamma receptors (FcgRs) through interaction with the constant domains. These interactions mediate effector functions such as antibody-dependent cellular cytotoxicity (ADCC) and antibody-dependent cellular phagocytosis (ADCP). Effector function activity is high for the IgG1 isotype, but very low or absent for IgG2 and IgG4 due to these isotypes having lower affinity for FcgRs. In addition, the effector function of IgG1 can be modified through mutation of amino acid residues within the constant regions to alter FcgR affinity and selectivity.

The binding of antibodies to Fc gamma receptors (FcγRs or FcgRs) was studied using biosensor technologies including Biacore surface plasmon resonance (SPR) and Fortebio Biolayer Interferometry (BLI). SPR studies were performed on a Biacore T100 instrument (GE Healthcare) at 25° C. The Fab fragment from a murine anti-6×His antibody was immobilized on a CM5 sensor chip using EDC/NHS to a density of ~3000 RU. Various his-tagged FcgRs (7 ug/ml) were captured via the C-terminal his-tag using a contact time of 30 s at 10 ul/min, and the binding of 1.0 μM antibody was evaluated in a running buffer of 10 mM NaPO4, 130 mM NaCl, 0.05% p20 (PBS-T) pH 7.1. FcgRs used for these experiments included CD64 (FcgRI), CD32a-H131 (FcgRIIa-H131), CD32a-R131 (FcgRIIa-R131), CD32b (FcgRIIb), CD16a-V158 (FcgRIIIa-V158), CD16b-NA1 (FcgRIIIb-NA1), and CD16B-NA2 (FcgRIIIb-NA2). BLI experiments were performed on a Fortebio Octet RED instrument (Pall, Fortebio) at 25° C. in 10 mM NaPO4, 130 mM NaCl, 0.05% p20 (PBS-T) pH 7.1. Antibodies were captured out of undiluted expression supernatants on protein A coated sensors, followed by the binding of 1 μM hCD32a-H131, hCD32a-R131, hCD32b, hCD16a-V158, or 0.1 μM hCD64 analytes.

Figure 33:
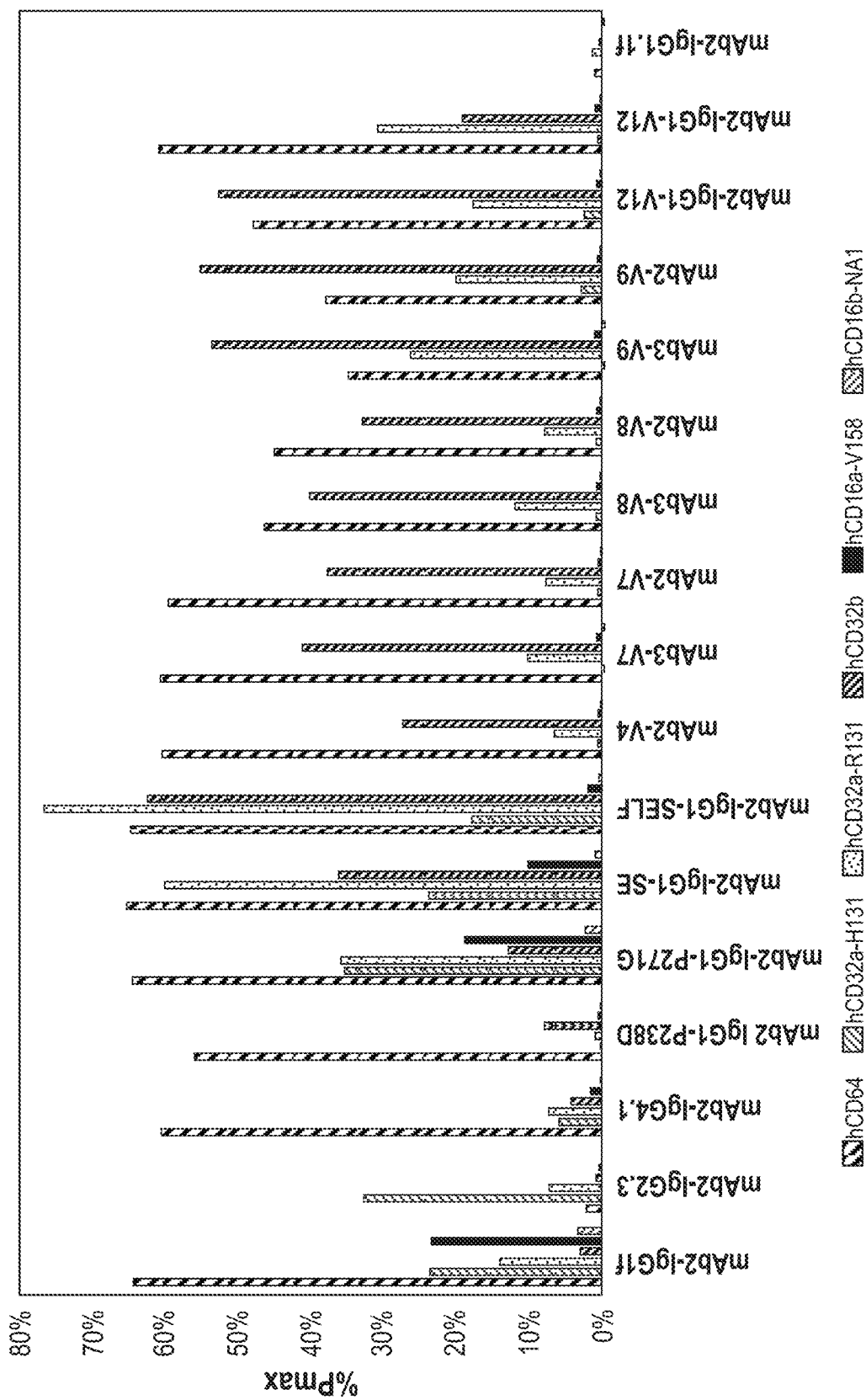
FIG. 33 shows antibody binding to anti-his Fab captured FcγR-his proteins. Binding responses are plotted as a percentage of the theoretical Rmax assuming a 1:1 mAb:FcγR binding stoichiometry. The bars for each antibody are shown in the order provided by the color legends at the bottom of the slide.

First, antibodies were made that contain modified IgG1 Fc domains including the substitutions S267E (SE) and S267E/L328F (SELF), as well as various combinations of the mutations P238D, P271G, H268D, A330R, G237D, E233D, referred to as V4, V7, V8, V9 and V12. The binding of these antibodies was studied by Biacore SPR with comparison to IgG1f, IgG2.3 (IgG2-C219S) and IgG4.1 (IgG4-S228P) antibodies, as well as an IgG1.1f antibody which has been engineered to reduce binding to all FcgRs. The results, which are shown in FIG. 33, demonstrate the expected FcgR binding properties for IgG1f, IgG2.3 and IgG4.1 and the mutated IgG1 antibodies, including increased CD32a-H131, CD32a-R131 and CD32b binding for SE and SELF, as well as increased selectivity of the V4, V7, V8, V9 and V12 mutants for CD32b over CD32a-H131 and CD32a-R131, FIG. 33.

The next set of constructs was used to engineer effector function into the otherwise effector function negative IgG2 isotype. For this study, the mutations described above were introduced in the context of an IgG2.3 constant region, or an IgG2.3/IgG1f hybrid termed IgG2.3G1-AY (Table 33). Antibodies were expressed at small scale as supernatants, and tested for binding to FcgRs using Fortebio Octet BioLayer Interferometry biosensor technology. Since the antibodies were present at low concentration in the supernatants, the experiment was performed by capturing antibodies out of the supernatants using protein A coated sensors, followed by binding of FcgR analytes in solution. Purified and supernatant control IgG1f including wild type IgG1, SE, P238D, V4 and V12 antibodies were also included for comparison, and each of these control antibodies demonstrated expected FcgR binding properties (FIG. 34). The IgG2.3 antibody also demonstrated the expected binding profile, with appreciable binding to only CD32a-H131. However, all mutations to introduce S267E, L328F, P238D, P271G, H268D, A330R, G237D, or E233D mutations into IgG2.3 failed to recapitulate the FcgR affinity of the corresponding engineered IgG1 mAbs (FIG. 34). In contrast, the IgG2.3G1-AY construct was able to fully preserve the FcgR binding properties of wild type IgG1, while retaining the CH1 and hinge regions of IgG2.3. In addition, all IgG2.3G1-AY mutants containing S267E, L328F, P238D, P271G, H268D, A330R, G237D, and E233D demonstrated FcgR binding properties comparable to the IgG1 version mAbs containing the same mutations (FIG. 34). This demonstrates the successful engineering of antibodies with CH1 and hinge regions of IgG2 combined with the effector function of wild type or mutant IgG1.

TABLE 33

| Engineered IgG2 constructs | | | |
|---|---|---|---|
| Set | ID | Construct | Seq ID# |
| 1 | IgG2.3 | hHC-IgG2-C219S | 268 |
| | IgG2.3-V13 | hHC-IgG2-C219S - P238D | 332 |
| | IgG2.3-V14 | hHC-IgG2-C219S - P238D, P271G | 333 |
| | IgG2.3-V15 | hHC-IgG2-C219S - P238D, H268D, P271G | 334 |
| | IgG2.3-V16 | hHC-IgG2-C219S - P238D, P271G, A330R | 335 |
| | IgG2.3-V17 | hHC-IgG2-C219S - P238D, H268D, P271G, A330R | 336 |
| | IgG2.3-V18 | hHC-IgG2-C219S - S267E | 337 |
| | IgG2.3-V19 | hHC-IgG2-C219S - S267E, L328F | 338 |
| 2 | IgG2.3G1 | hHC-IgG2-C219S/hHC-IgG1f | 269 |
| | IgG2.3G1-AY-V20 | hHC-IgG2-C219S/hHC-IgG1f - P238D | 339 |
| | IgG2.3G1-AY-V21 | hHC-IgG2-C219S/hHC-IgG1f - P238D, P271G | 340 |
| | IgG2.3G1-AY-V22 | hHC-IgG2-C219S/hHC-IgG1f - P238D, H268D, P271G | 341 |
| | IgG2.3G1-AY-V23 | hHC-IgG2-C219S/hHC-IgG1f - P238D, P271G, A330R | 342 |
| | IgG2.3G1-AY-V24 | hHC-IgG2-C219S/hHC-IgG1f - P238D, H268D, P271G, A330R | 343 |
| | IgG2.3G1-AY-V25 | hHC-IgG2-C219S/hHC-IgG1f - G237D, P238D, H268D, P271G, A330R | 344 |
| | IgG2.3G1-AY-V26 | hHC-IgG2-C219S/hHC-IgG1f - E233D, G237D, P238D, H268D, P271G, A330R | 345 |
| | IgG2.3G1-AY-V27 | hHC-IgG2-C219S/hHC-IgG1f - S267E | 346 |

TABLE 33-continued

| Engineered IgG2 constructs | | | |
|---|---|---|---|
| Set | ID | Construct | Seq ID# |
| | IgG2.3G1-AY-V28 | hHC-IgG2-C219S/hHC-IgG1f - S267E, L328F | 347 |

This engineering strategy was further explored by producing other antibodies formatted with IgG2.3G1-AY, IgG2.3G1-AY-S267E (IgG2.3G1-AY-V27), as well as IgG2-B-form variants (IgG2.5G1-AY and IgG2.5G1-AY-V27), and other hybrid antibodies containing different combinations of IgG1 and IgG2 constant domains, and testing the binding of these antibodies to anti-his Fab captured his-tagged FcgRs using Biacore SPR technology. In agreement with the Octet supernatant data, the SPR data showed that the IgG2.3G1-AY and IgG2.3G1-AY-V27 antibodies had comparable FcgR binding properties to IgG1f and IgG1f-S267E, respectively, despite containing the CH1 and hinge regions of an A-form IgG2 antibody (IgG2.3) (Table 34). Similar data was also obtained using IgG2.5G1-AY and IgG2.5G1-AY-V27 antibodies, demonstrating the successful engineering of B-form IgG2 antibodies (containing C131S mutation termed IgG2.5) having IgG1f or modified IgG1f like effector functions. Data for several other antibodies with IgG2.3G1-AY, IgG2.3G1-AY-V27, IgG2.5G1-AY, or IgG2.5G1-AY-V27 constant regions but different variable regions showed that this engineering strategy is broadly applicable to other antibodies independent of the variable domains (Table 34). Other constructs that demonstrate IgG1f-like FcgR binding properties include IgG1-G2.3G1-AY, and IgG1deltaTHT, whereas several of the modified constant region constructs were unable to retain IgG1f-like FcgR binding properties, including IgG2.3G1-KH, IgG2.5G1-KH, IgG2.3plusTHT, IgG2.5plusTHT and IgG2.3plusGGG constructs (Table 34).

TABLE 34

| % Rmax values for 1 μM antibody binding to anti-his Fab captured FcgR-his proteins | | | | | | |
|---|---|---|---|---|---|---|
| mAb | hCD64 | hCD32a-H131 | hCD32a-R131 | hCD32b | hCD16a-V158 | hCD16B-NA2 |
| mAb8-IgG1f | 80% | 82% | 51% | 27% | 51% | 21% |
| mAb9-IgG1f | 70% | 33% | 19% | 4% | 28% | 10% |
| CD73.4-IgG1f | 65% | 46% | 26% | 6% | 43% | 17% |
| CD73.4-IgG1.1f | 2% | 0% | 2% | 1% | 0% | 0% |
| mAb11-IgG2.3 | 2% | 44% | 17% | 5% | 1% | 0% |
| CD73.4-IgG2.3 | 3% | 48% | 11% | 1% | 1% | 0% |
| mAb6-IgG2.3 | 3% | 66% | 14% | 3% | 1% | 0% |
| mAb4-IgG2.3 | 1% | 39% | 6% | 1% | 1% | 0% |
| mAb5-IgG2.3 | 6% | 100% | 30% | 4% | 3% | 0% |
| mAb12-IgG2.3 | 2% | 39% | 7% | 1% | 1% | 0% |
| mAb13-IgG2.3 | 2% | 40% | 7% | 1% | 1% | 0% |
| mAb11-IgG2.5 | 0% | 40% | 13% | 3% | 0% | -1% |
| mAb7-IgG2.5 | 4% | 72% | 19% | 2% | 2% | 0% |
| mAb8-IgG2.5 | 3% | 59% | 14% | 3% | 2% | 0% |
| mAb10-IgG2.5 | 1% | 29% | 5% | 1% | 1% | 0% |
| CD73.4-IgG2.5 | 3% | 40% | 7% | 1% | 1% | 0% |
| mAb6-IgG2.5 | 3% | 75% | 17% | 4% | 2% | 0% |
| mAb4-IgG2.5 | 2% | 46% | 8% | 1% | 1% | 0% |
| mAb5-IgG2.5 | 6% | 89% | 26% | 5% | 4% | 1% |
| mAb12-IgG2.5 | 1% | 36% | 6% | 1% | 1% | 0% |
| mAb13-IgG2.5 | -2% | 39% | 4% | -2% | 0% | -2% |
| mAb8-IgG2.3G1-AY | 77% | 61% | 38% | 10% | 38% | 13% |
| mAb10-IgG2.3G1-AY | 67% | 23% | 14% | 4% | 24% | 8% |
| CD73.4-IgG2.3G1-AY | 65% | 38% | 20% | 5% | 38% | 14% |
| mAb7-IgG2.5G1-AY | 80% | 73% | 45% | 12% | 47% | 19% |
| mAb8-IgG2.5G1-AY | 77% | 70% | 45% | 17% | 48% | 22% |
| CD73.4-IgG2.5G1-AY | 65% | 43% | 24% | 7% | 40% | 16% |
| CD73.4-IgG2.3G1-KH | 2% | 15% | 2% | 0% | 2% | 0% |

TABLE 34-continued

% Rmax values for 1 µM antibody binding to anti-his Fab captured FcgR-his proteins

| mAb | hCD64 | hCD32a-H131 | hCD32a-R131 | hCD32b | hCD16a-V158 | hCD16B-NA2 |
|---|---|---|---|---|---|---|
| CD73.4-IgG2.5G1- KH | 2% | 17% | 2% | 0% | 3% | 0% |
| CD73.4-IgG2.3G1.1f-KH | 1% | 10% | 1% | 0% | 1% | 0% |
| CD73.4-IgG2.5G1.1f-KH | 1% | 6% | 1% | 0% | 1% | 0% |
| mAb7-IgG2.3G1-AY-V27 | 84% | 68% | 92% | 76% | 26% | 7% |
| mAb8-IgG2.3G1-AY-V27 | 78% | 67% | 80% | 67% | 24% | 7% |
| mAb10-IgG2.3G1-AY-V27 | 69% | 24% | 57% | 40% | 12% | 3% |
| mAb7-IgG2.5G1-AY-V27 | 81% | 74% | 89% | 84% | 32% | 9% |
| mAb8-IgG2.5G1-AY-V27 | 77% | 76% | 79% | 77% | 33% | 10% |
| CD73.4-IgG1-G2.3G1-AY | 66% | 50% | 31% | 10% | 48% | 23% |
| CD73.4-IgG1-G2.3G1-KH | 2% | 18% | 2% | 0% | 4% | 1% |
| CD73.4-IgG1deltaTHT | 65% | 43% | 23% | 6% | 42% | 17% |
| CD73.4-IgG2.3plusTHT | 3% | 42% | 8% | 1% | 1% | 0% |
| CD73.4-IgG2.5plusTHT | 2% | 34% | 7% | 1% | 1% | 0% |
| CD73.4-IgG2.3plusGGG | 3% | 43% | 8% | 1% | 1% | 0% |

Taken together these data show that the sequence in IgG1 immediately C-terminal to the conserved CPPCPAP (SEQ ID NO: 380) motif in the hinge region confers FcgR-mediated effector function, whereas the CH1 and upper portions of the hinge of the antibody can be replaced with IgG2 or modified IgG2 sequences, to potentially combine the effector functions of IgG1 and modified IgG1 with the superior internalization or signaling properties of antibodies containing IgG2 CH1 and/or hinge regions.

Equivalents

Those skilled in the art will recognize or be able to ascertain, using no more than routine experimentation, many equivalents of the specific embodiments described herein described herein. Such equivalents are intended to be encompassed by the following claims.

SUMMARY OF SEQUENCE LISTING

TABLE 35

| SEQ ID | Description | Sequence |
|---|---|---|
| 1 | Human CD73 isoform 1 | MCPRAARAPA TLLLALGAVL WPAAGAWELT ILHTNDVHSR LEQTSEDSSK CVNASRCMGG VARLFTKVQQ IRRAEPNVLL LDAGDQYQGT IWFTVYKGAE VAHFMNALRY DAMALGNHEFDNGVEGLIEP LLKEAKFPIL SANIKAKGPL ASQISGLYLP YKVLPVGDEV VGIVGYTSKE TPFLSNPGTN LVFEDEITAL QPEVDKLKTL NVNKIIALGH SGFEMDKLIA QKVRGVDVVV GGHSNTFLYT GNPPSKEVPA GKYPFIVTSD DGRKVPVVQA YAFGKYLGYL KIEFDERGNV ISSHGNPILL NSSIPEDPSI KADINKWRIK LDNYSTQELG KTIVYLDGSS QSCRFRECNM GNLICDAMIN NNLRHTDEMF WNHVSMCILN GGGIRSPIDE RNNGTITWEN LAAVLPFGGT FDLVQLKGST LKKAFEHSVH RYGQSTGEFL QVGGIHVVYD LSRKPGDRVV KLDVLCTKCRVPSYDPLKMD EVYKVILPNF LANGGDGFQM IKDELLRHDS GDQDINVVST YISKMKVIYP AVEGRIKFST GSHCHGSFSL IFLSLWAVIF VLYQ |
| 2 | Human CD73 isoform 2 | MCPRAARAPA TLLLALGAVL WPAAGAWELT ILHTNDVHSR LEQTSEDSSK CVNASRCMGGVARLFTKVQQ IRRAEPNVLL LDAGDQYQGT IWFTVYKGAE VAHFMNALRY DAMALGNHEFDNGVEGLIEP LLKEAKFPIL SANIKAKGPL ASQISGLYLP YKVLPVGDEV VGIVGYTSKETPFLSNPGTN LVFEDEITAL QPEVDKLKTL NVNKIIALGH SGFEMDKLIA QKVRGVDVVVGGHSNTFLYT GNPPSKEVPA GKYPFIVTSD DGRKVPVVQA YAFGKYLGYL KIEFDERGNVISSHGNPILL NSSIPEDPSI KADINKWRIK LDNYSTQELG KTIVYLDGSS QSCRFRECNMGNLICDAMIN NNLRHTDEMF WNHVSMCILN GGGIRSPIDE RNNGIHVVYD LSRKPGDRVVKLDVLCTKCR VPSYDPLKMD EVYKVILPNF LANGGDGFQM IKDELLRHDS GDQDINVVSTYISKMKVIYP AVEGRIKFST GSHCHGSFSL IFLSLWAVIF VLYQ |

TABLE 35-continued

| SEQ ID | Description | Sequence |
|---|---|---|
| 3 | Cynomolgus CD73 | MCPRAARAPA TLLLAVGALL WSAAGAWELT ILHTNDVHSR LEQTSEDSSK CVNASRCMGGVARLFTKVQQ IRRAEPNVLL LDAGDQYQGT IWFTVYKGAE VAHFMNALRY DAMALGNHEFDNGVEGLIEP LLKEAKFPIL SANIKAKGPL ASQISGLYLP YKVLPVGDEV VGIVGYTSKETPFLSNPGTN LVFEDEITAL QPEVDKLKTL NVNKIIALGH SGFETDKLIA QKVRGVDVVVGGHSNTFLYT GNPPSKEVPA GKYPFIVTSD DGRKVPVVQA YAFGKYLGYL KIEFDERGNVISSHGNPILL NSSIPEDPSI KADINKWRIK LDNYSTQELG KTIVYLDGSS QSCRFRECNMGNLICDAMIN NNLRHADEMF WNHVSMCILN GGGIRSPIDE RNNGTITWEN LAAVLPFGGTFDLVQLKGST LKKAFEHSVH RYGQSTGEFL QVGGIHVVYD LSRKPGDRVV KLDVLCTKCRVPSYDPLKMD EIYKVILPNF LANGGDGFQM IKDELLRHDS GDQDINVVST YISKMKVIYPAVEGRIKFST GSHCGSFSL IFLSFCAVIF VLYQ |
| 4 | 11F11 VH | QVQLVESGGGVVQPGRSLRLSCATSGFTFSNYGMH WVRQAPGKGLEWVAVILYDGSNKYYPDSVKGRFT ISRDNSKNTLYLQMNSLRAEDTAVYYCARGGSSW YPDSFDIWGQGTMVTVSS |
| 5 | 11F11 VH CDR1 | NYGMH |
| 6 | 11F11 VH CDR2 | VILYDGSNKYYPDSVKG |
| 7 | 11F11 VH CDR3 | GGSSWYPDSFDI |
| 8 | 11F11 VK1 | EIVLTQSPATLSLSPGERATLSCRASQGVSSYLAWY QQKPGQAPRLLIYDASNRATGIPARFSGSGPGTDFT LTISSLEPEDFAVYYCQQRSNWHLTFGGGTKVEIK |
| 9 | 11F11 VK1 CDR1 | RASQGVSSYLA |
| 10 | 11F11 VK1 CDR2 | DASNRAT |
| 11 | 11F11 VK1 CDR3 | QQRSNWHLT |
| 12 | 11F11 VK2 | DIQMTQSPSSLSASVGDRVTITCRASQGISSWLAWY QQKPEKAPKSLIYAASSLQSGVPSRFSGSGSTDFT LTISSLQPEDFATYYCQQYNSYPLTFGGGTKVEIK |
| 13 | 11F11 VK2 CDR1 | RASQGISSWLA |
| 14 | 11F11 VK2 CDR2 | AASSLQS |
| 15 | 11F11 VK2 CDR3 | QQYNSYPLT |
| 16 | 4C3 VH | EVQLVESGGGLVQPGRSLRLSCAASGFTFDDYAM HWVRQAPGKGLEWVSGISWKSGSIGYADSVKGRF TISRDNAKNSLYLQMNSLRAEDTALYYCVKGYYVI LTGLDYWGQGTLVTVS S |
| 17 | 4C3 VH CDR1 | DYAMH |
| 18 | 4C3 VH CDR2 | GISWKSGSIGYADSVKG |
| 19 | 4C3 VH CDR3 | GYYVILTGLDY |
| 20 | 4C3 VK1 | EIVLTQSPGTLSLSPGERATLSCRASQSVSSYLAWY QQKPGQAPRLLIYGASSRATGIPDRFSGSGSTDFT LTISRLEPEDFAVYYCQQYGSSPLTFGGGTKVEIK |
| 21 | 4C3 VK1 CDR1 | RASQSVSSYLAW |
| 22 | 4C3 VK1 CDR2 | ASSRATG |
| 23 | 4C3 VK1 CDR3 | QYGSSPLT |
| 24 | 4C3 VK2 | DIQMTQSPSSLSASVGDRVTFTCRASQGISSWLAW YQQKPEKAPKSLIYAASSLQSGVPSRFSGSGSTDF TLTISSLQPEDFATYYCQQYNSYPPTFGQGTKVEIK |

TABLE 35-continued

| SEQ ID | Description | Sequence |
|---|---|---|
| 25 | 4C3 VK2 CDR1 | RASQGISSWLA |
| 26 | 4C3 VK2 CDR2 | AASSLQS |
| 27 | 4C3 VK2 CDR3 | QQYNSYPPT |
| 28 | 4C3 VK3 | DIQMTQSPSSLSASVGDRVTFTCRASQGISSWLAW YQQKPEKAPKSLIYAASSLQSGVPSRFSGSGSTDF TLTISSLQPEDFATYYCQQYNSYPPTFGQGTKVEIK |
| 29 | 4C3 VK3 CDR1 | RASQGISSWLA |
| 30 | 4C3 VK3 CDR2 | AASSLQS |
| 31 | 4C3 VK3 CDR3 | QQYNSYPPT |
| 32 | 4D4 VH | QVQLVESGGGVVQPGRSLRLSCAASGFTFSNYGM HWVRQAPGKGLEWVAVIWYDESNKYYADSVKGR FTISRDNSKNTLFLQMNSLRAEDTAVYYCARGYNS RWYPDAFDIWGQGTMVT VSS |
| 33 | 4D4 VH CDR1 | NYGMH |
| 34 | 4D4 VH CDR2 | VIWYDESNKYYADSVKG |
| 35 | 4D4 VH CDR3 | GYNSRWYPDAFDI |
| 36 | 4D4 VK1 | DIQMTQSPSSLSASVGDRVTITCRASQGISSWLAWY QQKPEKAPKSLIYAASSLQSGVPSRFSGSGSTDFT LTISSLQPEDFATYYCQQYNSYPLTFGGGTKVEIK |
| 37 | 4D4 VK1 CDR1 | RASQGISSWLA |
| 38 | 4D4 VK1 CDR2 | AASSLQS |
| 39 | 4D4 VK1 CDR3 | QQYNSYPLT |
| 40 | 10D2 VH1 | QVQLVESGGGVVQPGRSLRLSCAASGFTFSNYGLH WVRQAPGKGLEWVAVIRYDGSNKYYADSVKGRF TISRDNSKNTLYLQMSSLRAEDTAVYYCARGGSSW YPDGLDVWGQGTTVTV SS |
| 41 | 10D2 VH1 CDR1 | NYGLH |
| 42 | 10D2 VH1 CDR2 | VIRYDGSNKYYADSVKG |
| 43 | 10D2 VH1 CDR3 | GGSSWYPDGLDV |
| 44 | 10D2 VK1 | AIQLTQSPSSLSASVGDRVTITCRASQGISSALAWY QQKPGKAPKLLIYDASSLESGVPSRFSGSGSTDFT LTISSLQPEDFATYYCQQFNSYPTFGGGTKVEIK |
| 45 | 10D2 VK1 CDR1 | RASQGISSALA |
| 46 | 10D2 VK1 CDR2 | DASSLES |
| 47 | 10D2 VK1 CDR3 | QQFNSYPT |
| 48 | 10D2 VK2 | DIQMTQSPSSLSASVGDRVTITCRASQGISSWLAWY QQKPEKAPKSLIYAASSLQSGVPSRFSGSGSTDFT LTISSLQPEDFATYYCQQYNSYPLTFGGGTKVEIK |
| 49 | 10D2 VK2 CDR1 | RASQGISSWLA |
| 50 | 10D2 VK2 CDR2 | AASSLQS |
| 51 | 10D2 VK2 CDR3 | QQYNSYPLT |
| 52 | 11A6 VH | EVQLVESGGNLVQPGRSLRLSCAASGFTFDDYAM HWVRQAPGKGLEWVSGISWNNNDIGYADSVKGRF IISRDNAKNSLYLQMNSLRPEDTALYYCVKGYYVI LTGLDYWGQGTPVTVS S |
| 53 | 11A6 VH CDR1 | DYAMH |
| 54 | 11A6 VH CDR2 | GISWNNNDIGYADSVKG |

TABLE 35-continued

| SEQ ID | Description | Sequence |
|---|---|---|
| 55 | 11A6 VH CDR3 | GYYVILTGLDY |
| 56 | 11A6 VK1 | DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK |
| 57 | 11A6 VK1 CDR1 | RASQGISSWLA |
| 58 | 11A6 VK1 CDR2 | AASSLQS |
| 59 | 11A6 VK1 CDR3 | QQYNSYPLT |
| 60 | 24H2 VH | QVQLVESGGGVVQPGRSLRLSCAASGFTFSNYGMHWVRQAPGKGLEWVAVIWYDGGNKYYADSVKGRFTISRDNSKNTLFLQMNSLRAEDTAVYYCARGGSSWYPDAFDIWGQGTMVTVSS |
| 61 | 24H2 VH CDR1 | NYGMH |
| 62 | 24H2 VH CDR2 | VIWYDGGNKYYADSVKG |
| 63 | 24H2 VH CDR3 | GGSSWYPDAFDI |
| 64 | 24H2 VK1 | DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK |
| 65 | 24H2 VK1 CDR1 | RASQGISSWLA |
| 66 | 24H2 VK1 CDR2 | AASSLQS |
| 67 | 24H2 VK1 CDR3 | QQYNSYPLT |
| 68 | 5F8 VH | EVQLVESGGGLVQPGGSLRLSCAASGFTFSSYWMHWVRQAPGKGLVWVSRIISDGSSTGYADSVKGRFTISRDNAKNTLYLQMNSLRAEDTAVYYCAREFSSGWYFDYWGQGTLVTVSS |
| 69 | 5F8 VH CDR1 | SYWMH |
| 70 | 5F8 VH CDR2 | RIISDGSSTGYADSVKG |
| 71 | 5F8 VH CDR3 | EFSSGWYFDY |
| 72 | 5F8 VK1 | AIQLTQSPSSLSASVGDRVTITCRASQGISSALAWYQQKPGKAPKLLIYDASSLESGVPSRFSGSGSGTDFTLTISSLQPEDFATYYCQQFSSYPRTFGQGTKVEIK |
| 73 | 5F8 VK1 CDR1 | RASQGISSALA |
| 74 | 5F8 VK1 CDR2 | DASSLES |
| 75 | 5F8 VK1 CDR3 | QQFSSYPRT |
| 76 | 5F8 VK2 | DIQMTQSPSSLSASVGDRVTITCRASQGISSWLAWYQQKPEKAPKSLIYAASSLQSGVPSRFSGSGSGTGFTLTISSLQPEDFATYYCQQYNSYPRTFGQGTKVEIK |
| 77 | 5F8 VK2 CDR1 | RASQGISSWLA |
| 78 | 5F8 VK2 CDR2 | AASSLQS |
| 79 | 5F8 VK2 CDR3 | QQYNSYPRT |
| 80 | 6E11 VH | EVQLVESGGALVQPGRSLRLSCAASGFTFDDYAMHWVRQAPGKGLEWVSGITWNSGGIGYADSVKGRFTISRDNAKNSLYLQMNSLRAEDTALYYCAKDRYYSSWLLFDNWGQGILVTVSS |
| 81 | 6E11 VH CDR1 | DYAMH |
| 82 | 6E11 VH CDR2 | GITWNSGGIGYADSVKG |
| 83 | 6E11 VH CDR3 | DRYYSSWLLFDN |

TABLE 35-continued

| SEQ ID | Description | Sequence |
|---|---|---|
| 84 | 6E11 VK1 | EIVLTQSPGTLSLSPGERATLSCRASQSVSSSYLAWYQQKPGQAPRLLIYGASSRATGIPDRFSGSGSGTDFTLTISRLEPEDFAVYYCQHYGSSFTFGPGTKVDIK |
| 85 | 6E11 VK1 CDR1 | RASQSVSSSYLA |
| 86 | 6E11 VK1 CDR2 | GASSRAT |
| 87 | 6E11 VK1 CDR3 | QHYGSSFT |
| 88 | 7A11 VH | EVQLVESGGGLVQTGRSLRLSCAASGFTFDDYAMHWVRQAPGKGLEWVSDISWNSDIIGYADSVKGRFTISRDNAKNSLYLQMNSLRAEDTALYYCAKDIYGSGSSFFDYWGQGILVTVSS |
| 89 | 7A11 VH CDR1 | DYAMH |
| 90 | 7A11 VH CDR2 | DISWNSDIIGYADSVKG |
| 91 | 7A11 VH CDR3 | DIYGSGSSFFDY |
| 92 | 7A11 VK1 | DIQMTQSPSSLSASVGDRVTITCRASQYISSWLAWYQQKPEKAPKSLIYAASSLQSGVPSRFSGSGSGTDFTLTISSLQPEDFATYYCQQYHSYPPTFGQGTRLEIK |
| 93 | 7A11 VK1 CDR1 | RASQYISSWLA |
| 94 | 7A11 VK1 CDR2 | AASSLQS |
| 95 | 7A11 VK1 CDR3 | QQYHSYPPT |
| 96 | 11F11 epitope #1 | FTKVQQIRRAEPNVLLLDA |
| 97 | 11F11 epitope #2 | LYLPYKVLPVGDEVVG |
| 98 | Wildtype IgG1 CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV |
| 99 | His-tagged CD73 | MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHADETFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKHHHHHH |
| 100 | 11F11 (full length heavy chain) | QVQLVESGGGVVQPGRSLRLSCATSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS<u>ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK</u> |
| 101 | 11F11 (full length light chain 1) | EIVLTQSPATLSLSPGERATLSCRASQGVSSYLAWYQQKPGQAPRLLIYDASNRATGIPARFSGSGPGTDFTLTISSLEPEDFAVYYCQQRSNWHLTFGGGTKVEIK<u>RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC</u> |

TABLE 35-continued

| SEQ ID | Description | Sequence |
|---|---|---|
| 102 | 11F11 (full length light chain 2) | DIQMTQSPSSLSASVGDRVTITCRASQGISSWLAWY QQKPEKAPKSLIYAASSLQSGVPSRFSGSGSGTDFT LTISSLQPEDFATYYCQQYNSYPLTFGGGTKVEIK<u>R TVAAPSVFIFPPSDEQLKSGTASVVCLLNNFYPREA KVQWKVDNALQSGNSQESVTEQDSKDSTYSLSSTL TLSKADYEKHKVYACEVTHQGLSSPVTKSFNRGEC</u> |
| 103 | 4C3 (full length heavy chain) | EVQLVESGGGLVQPGRSLRLSCAASGFTFDDYAM HWVRQAPGKGLEWVSGISWKSGSIGYADSVKGRF TISRDNAKNSLYLQMNSLRAEDTALYYCVKGYYVI LTGLDYWGQGTLVTVSS<u>ASTKGPSVFPLAPSSKSTS GGTAALGCLVKDYFPEPVTVSWNSGALTSGVHTFP AVLQSSGLYSLSSVVTVPSSSLGTQTYICNVNHKPS NTKVDKKVEPKSCDKTHTCPPCPAPELLGGPSVFLF PPKPKDTLMISRTPEVTCVVVDVSHEDPEVKFNWY VDGVEVHNAKTKPREEQYNSTYRVVSVLTVLHQD WLNGKEYKCKVSNKALPAPIEKTISKAKGQPREPQ VYTLPPSRDELTKNQVSLTCLVKGFYPSDIAVEWES NGQPENNYKTTPPVLDSDGSFFLYSKLTVDKSRWQ QGNVFSCSVMHEALHNHYTQKSLSLSPGK</u> |
| 104 | 4C3 (full length light chain 1) | EIVLTQSPGTLSLSPGERATLSCRASQSVSSYLAWY QQKPGQAPRLLIYGASSRATGIPDRFSGSGSGTDFT LTISRLEPEDFAVYYCQQYGSSPLTFGGGTKVEIK<u>R TVAAPSVFIFPPSDEQLKSGTASVVCLLNNFYPREA KVQWKVDNALQSGNSQESVTEQDSKDSTYSLSSTL TLSKADYEKHKVYACEVTHQGLSSPVTKSFNRGEC</u> |
| 105 | 4C3 (full length light chain 2) | DIQMTQSPSSLSASVGDRVTFTCRASQGISSWLAW YQQKPEKAPKSLIYAASSLQSGVPSRFSGSGSGTDF TLTISSLQPEDFATYYCQQYNSYPPTFGQGTKVEIK <u>RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNRG EC</u> |
| 106 | 4C3 (full length light chain 3) | DIQMTQSPSSLSASVGDRVTFTCRASQGISSWLAW YQQKPEKAPKSLIYAASSLQSGVPSRFSGSGSGTDF TLTISSLQPEDFATYYCQQYNSYPPTFGQGTKVEIK <u>RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNRG EC</u> |
| 107 | 4D4 (full length heavy chain) | QVQLVESGGGVVQPGRSLRLSCAASGFTFSNYGM HWVRQAPGKGLEWVAVIWYDESNKYYADSVKGR FTISRDNSKNTLFLQMNSLRAEDTAVYYCARGYNS RWYPDAFDIWGQGTMVTVSS<u>ASTKGPSVFPLAPCS RSTSESTAALGCLVKDYFPEPVTVSWNSGALTSGV HTFPAVLQSSGLYSLSSVVTVPSSNFGTQTYTCNVD HKPSNTKVDKTVERKCCVECPPCPAPPVAGPSVFL FPPKPKDTLMISRTPEVTCVVVDVSHEDPEVQFNW YVDGVEVHNAKTKPREEQFNSTFRVVSVLTVVHQ DWLNGKEYKCKVSNKGLPAPIEKTISKTKGQPREP QVYTLPPSREEMTKNQVSLTCLVKGFYPSDIAVEW ESNGQPENNYKTTPPMLDSDGSFFLYSKLTVDKSR WQQGNVFSCSVMHEALHNHYTQKSLSLSPGK</u> |
| 108 | 4D4 (full length light chain 1) | DIQMTQSPSSLSASVGDRVTITCRASQGISSWLAWY QQKPEKAPKSLIYAASSLQSGVPSRFSGSGSGTDFT LTISSLQPEDFATYYCQQYNSYPLTFGGGTKVEIK<u>R TVAAPSVFIFPPSDEQLKSGTASVVCLLNNFYPREA KVQWKVDNALQSGNSQESVTEQDSKDSTYSLSSTL TLSKADYEKHKVYACEVTHQGLSSPVTKSFNRGEC</u> |
| 109 | 10D2 (full length heavy chain) | QVQLVESGGGVVQPGRSLRLSCAASGFTFSNYGLH WVRQAPGKGLEWVAVIRYDGSNKYYADSVKGRF TISRDNSKNTLYLQMSSLRAEDTAVYYCARGGSSW YPDGLDVWGQGTTVTVSS<u>ASTKGPSVFPLAPCSRS TSESTAALGCLVKDYFPEPVTVSWNSGALTSGVHT FPAVLQSSGLYSLSSVVTVPSSSLGTKTYTCNVDHK PSNTKVDKRVESKYGPPCPSCPAPEFLGGPSVFLFP PKPKDTLMISRTPEVTCVVVDVSQEDPEVQFNWYV DGVEVHNAKTKPREEQFNSTYRVVSVLTVLHQDW LNGKEYKCKVSNKGLPSSIEKTISKAKGQPREPQVY TLPPSQEEMTKNQVSLTCLVKGFYPSDIAVEWESN</u> |

TABLE 35-continued

| SEQ ID | Description | Sequence |
|---|---|---|
| | | GQPENNYKTTPPVLDSDGSFFLYSRLTVDKSRWQE GNVFSCSVMHEALHNHYTQKSLSLSLGK |
| 110 | 10D2 (full length light chain 1) | AIQLTQSPSSLSASVGDRVTITCRASQGISSALAWY QQKPGKAPKLLIYDASSLESGVPSRFSGSGSGTDFT LTISSLQPEDFATYYCQQFNSYPTFGGGTKVEIKRT VAAPSVFIFPPSDEQLKSGTASVVCLLNNFYPREAK VQWKVDNALQSGNSQESVTEQDSKDSTYSLSSTLT LSKADYEKHKVYACEVTHQGLSSPVTKSFNRGEC |
| 111 | 10D2 (full length light chain 2) | DIQMTQSPSSLSASVGDRVTITCRASQGISSWLAWY QQKPEKAPKSLIYAASSLQSGVPSRFSGSGSGTDFT LTISSLQPEDFATYYCQQYNSYPLTFGGGTKVEIKR TVAAPSVFIFPPSDEQLKSGTASVVCLLNNFYPREA KVQWKVDNALQSGNSQESVTEQDSKDSTYSLSSTL TLSKADYEKHKVYACEVTHQGLSSPVTKSFNRGEC |
| 112 | 11A6 (full length heavy chain) | EVQLVESGGNLVQPGRSLRLSCAASGFTFDDYAM HWVRQAPGKGLEWVSGISWNNNDIGYADSVKGRF IISRDNAKNSLYLQMNSLRPEDTALYYCVKGYYVI LTGLDYWGQGTPVTVSSASTKGPSVFPLAPSSKSTS GGTAALGCLVKDYFPEPVTVSWNSGALTSGVHTFP AVLQSSGLYSLSSVVTVPSSSLGTQTYICNVNHKPS NTKVDKKVEPKSCDKTHTCPPCPAPELLGGPSVFLF PPKPKDTLMISRTPEVTCVVVDVSHEDPEVKFNWY VDGVEVHNAKTKPREEQYNSTYRVVSVLTVLHQD WLNGKEYKCKVSNKALPAPIEKTISKAKGQPREPQ VYTLPPSRDELTKNQVSLTCLVKGFYPSDIAVEWES NGQPENNYKTTPPVLDSDGSFFLYSKLTVDKSRWQ QGNVFSCSVMHEALHNHYTQKSLSLSPGK |
| 113 | 11A6 (full length light chain 1) | DIQMTQSPSSLSASVGDRVTITCRASQGISSWLAWY QQKPEKAPKSLIYAASSLQSGVPSRFSGSGSGTDFT LTISSLQPEDFATYYCQQYNSYPLTFGGGTKVEIKR TVAAPSVFIFPPSDEQLKSGTASVVCLLNNFYPREA KVQWKVDNALQSGNSQESVTEQDSKDSTYSLSSTL TLSKADYEKHKVYACEVTHQGLSSPVTKSFNRGEC |
| 114 | 24H2 (full length heavy chain) | QVQLVESGGGVVQPGRSLRLSCAASGFTFSNYGM HWVRQAPGKGLEWVAVIWYDGGNKYYADSVKG RFTISRDNSKNTLFLQMNSLRAEDTAVYYCARGGS SWYPDAFDIWGQGTMVTVSSASTKGPSVFPLAPCS RSTSESTAALGCLVKDYFPEPVTVSWNSGALTSGV HTFPAVLQSSGLYSLSSVVTVPSSSLGTKTYTCNVD HKPSNTKVDKRVESKYGPPCPSCPAPEFLGGPSVFL FPPKPKDTLMISRTPEVTCVVVDVSQEDPEVQFNW YVDGVEVHNAKTKPREEQFNSTYRVVSVLTVLHQ DWLNGKEYKCKVSNKGLPSSIEKTISKAKGQPREP QVYTLPPSQEEMTKNQVSLTCLVKGFYPSDIAVEW ESNGQPENNYKTTPPVLDSDGSFFLYSRLTVDKSR WQEGNVFSCSVMHEALHNHYTQKSLSLSLGK |
| 115 | 24H2 (full length light chain 1) | DIQMTQSPSSLSASVGDRVTITCRASQGISSWLAWY QQKPEKAPKSLIYAASSLQSGVPSRFSGSGSGTDFT LTISSLQPEDFATYYCQQYNSYPLTFGGGTKVEIKR TVAAPSVFIFPPSDEQLKSGTASVVCLLNNFYPREA KVQWKVDNALQSGNSQESVTEQDSKDSTYSLSSTL TLSKADYEKHKVYACEVTHQGLSSPVTKSFNRGEC |
| 116 | 5F8 (full length heavy chain) | EVQLVESGGGLVQPGGSLRLSCAASGFTFSSYWMH WVRQAPGKGLVWVSRIISDGSSTGYADSVKGRFTI SRDNAKNTLYLQMNSLRAEDTAVYYCAREFSSGW YFDYWGQGTLVTVSSASTKGPSVFPLAPSSKSTSG GTAALGCLVKDYFPEPVTVSWNSGALTSGVHTFPA VLQSSGLYSLSSVVTVPSSSLGTQTYICNVNHKPSN TKVDKKVEPKSCDKTHTCPPCPAPELLGGPSVFLFP PKPKDTLMISRTPEVTCVVVDVSHEDPEVKFNWYV DGVEVHNAKTKPREEQYNSTYRVVSVLTVLHQDW LNGKEYKCKVSNKALPAPIEKTISKAKGQPREPQV YTLPPSRDELTKNQVSLTCLVKGFYPSDIAVEWESN GQPENNYKTTPPVLDSDGSFFLYSKLTVDKSRWQQ GNVFSCSVMHEALHNHYTQKSLSLSPGK |
| 117 | 5F8 (full length light chain 1) | AIQLTQSPSSLSASVGDRVTITCRASQGISSALAWY QQKPGKAPKLLIYDASSLESGVPSRFSGSGSGTDFT LTISSLQPEDFATYYCQQFSSYPRTFGQGTKVEIKRT VAAPSVFIFPPSDEQLKSGTASVVCLLNNFYPREAK |

TABLE 35-continued

| SEQ ID | Description | Sequence |
|---|---|---|
| | | VQWKVDNALQSGNSQESVTEQDSKDSTYSLSSTLT<br>LSKADYEKHKVYACEVTHQGLSSPVTKSFNRGEC |
| 118 | 5F8 (full length light chain 2) | DIQMTQSPSSLSASVGDRVTITCRASQGISSWLAWY<br>QQKPEKAPKSLIYAASSLQSGVPSRFSGSGSGTGFT<br>LTISSLQPEDFATYYCQQYNSYPRTFGQGTKVEIKR<br>TVAAPSVFIFPPSDEQLKSGTASVVCLLNNFYPREA<br>KVQWKVDNALQSGNSQESVTEQDSKDSTYSLSSTL<br>TLSKADYEKHKVYACEVTHQGLSSPVTKSFNRGEC |
| 119 | 6E11 (full length heavy chain) | EVQLVESGGALVQPGRSLRLSCAASGFTFDDYAM<br>HWVRQAPGKGLEWVSGITWNSGGIGYADSVKGRF<br>TISRDNAKNSLYLQMNSLRAEDTALYYCAKDRYY<br>SSWLLFDNWGQGILVTVSSASTKGPSVFPLAPSSKS<br>TSGGTAALGCLVKDYFPEPVTVSWNSGALTSGVHT<br>FPAVLQSSGLYSLSSVVTVPSSSLGTQTYICNVNHK<br>PSNTKVDKKVEPKSCDKTHTCPPCPAPELLGGPSVF<br>LFPPKPKDTLMISRTPEVTCVVVDVSHEDPEVKFN<br>WYVDGVEVHNAKTKPREEQYNSTYRVVSVLTVLH<br>QDWLNGKEYKCKVSNKALPAPIEKTISKAKGQPRE<br>PQVYTLPPSRDELTKNQVSLTCLVKGFYPSDIAVE<br>WESNGQPENNYKTTPPVLDSDGSFFLYSKLTVDKS<br>RWQQGNVFSCSVMHEALHNHYTQKSLSLSPGK |
| 120 | 6E11 (full length light chain 1) | EIVLTQSPGTLSLSPGERATLSCRASQSVSSSYLAW<br>YQQKPGQAPRLLIYGASSRATGIPDRFSGSGSGTDF<br>TLTISRLEPEDFAVYYCQHYGSSFTFGPGTKVDIKR<br>TVAAPSVFIFPPSDEQLKSGTASVVCLLNNFYPREA<br>KVQWKVDNALQSGNSQESVTEQDSKDSTYSLSSTL<br>TLSKADYEKHKVYACEVTHQGLSSPVTKSFNRGEC |
| 121 | 7A11 (full length heavy chain) | EVQLVESGGGLVQTGRSLRLSCAASGFTFDDYAM<br>HWVRQAPGKGLEWVSDIWNSDIIGYADSVKGRF<br>TISRDNAKNSLYLQMNSLRAEDTALYYCAKDIYGS<br>GSSFFFDYWGQGILVTVSSASTKGPSVFPLAPSSKST<br>SGGTAALGCLVKDYFPEPVTVSWNSGALTSGVHTF<br>PAVLQSSGLYSLSSVVTVPSSSLGTQTYICNVNHKP<br>SNTKVDKKVEPKSCDKTHTCPPCPAPELLGGPSVFL<br>FPPKPKDTLMISRTPEVTCVVVDVSHEDPEVKFNW<br>YVDGVEVHNAKTKPREEQYNSTYRVVSVLTVLHQ<br>DWLNGKEYKCKVSNKALPAPIEKTISKAKGQPREP<br>QVYTLPPSRDELTKNQVSLTCLVKGFYPSDIAVEW<br>ESNGQPENNYKTTPPVLDSDGSFFLYSKLTVDKSR<br>WQQGNVFSCSVMHEALHNHYTQKSLSLSPGK |
| 122 | 7A11 (full length light chain 1) | DIQMTQSPSSLSASVGDRVTITCRASQYISSWLAWY<br>QQKPEKAPKSLIYAASSLQSGVPSRFSGSGSGTDFT<br>LTISSLQPEDFATYYCQQYHSYPPTFGQGTRLEIKR<br>TVAAPSVFIFPPSDEQLKSGTASVVCLLNNFYPREA<br>KVQWKVDNALQSGNSQESVTEQDSKDSTYSLSSTL<br>TLSKADYEKHKVYACEVTHQGLSSPVTKSFNRGEC |
| 123 | Hinge C219S | ERKCVECPPCPAPPVAG |
| 124 | IgG2 CH1 (wildtype) | ASTKGPSVFPLAPCSRSTSESTAALGCLVKDYFPEP<br>VTVSWNSGALTSGVHTFPAVLQSSGLYSLSSVVTV<br>PSSNFGTQTYTCNVDHKPSNTKVDKTV |
| 125 | IgG1 CH2 + A330S and P331S | PSVFLFPPKPKDTLMISRTPEVTCVVVDVSHEDPEV<br>KFNWYVDGVEVHNAKTKPREEQYNSTYRVVSVLT<br>VLHQDWLNGKEYKCKVSNKALPSSIEKTISKAK |
| 126 | Human IgG1 constant region | ASTKGPSVFPLAPSSKSTSGGTAALGCLVKDYFPEP<br>VTVSWNSGALTSGVHTFPAVLQSSGLYSLSSVVTV<br>PSSSLGTQTYICNVNHKPSNTKVDKKVEPKSCDKT<br>HTCPPCPAPELLGGPSVFLFPPKPKDTLMISRTPEVT<br>CVVVDVSHEDPEVKFNWYVDGVEVHNAKTKPRE<br>EQYNSTYRVVSVLTVLHQDWLNGKEYKCKVSNK<br>ALPAPIEKTISKAKGQPREPQVYTLPPSRDELTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK |
| 127 | Human IgG1 constant region (allotype variant) | ASTKGPSVFPLAPSSKSTSGGTAALGCLVKDYFPEP<br>VTVSWNSGALTSGVHTFPAVLQSSGLYSLSSVVTV<br>PSSSLGTQTYICNVNHKPSNTKVDKKVEPKSCDKT<br>HTCPPCPAPELLGGPSVFLFPPKPKDTLMISRTPEVT |

TABLE 35-continued

| SEQ ID | Description | Sequence |
|---|---|---|
| | | CVVVDVSHEDPEVKFNWYVDGVEVHNAKTKPRE EQYNSTYRVVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK |
| 128 | IgG1 CH3 + E356 and M358 | GQPREPQVYTLPPSREEMTKNQVSLTCLVKGFYPS DIAVEWESNGQPENNYKTTPPVLDSDGSFFLYSKL TVDKSRWQQGNVFSCSVMHEALHNHYTQKSLSLS PGK |
| 129 | IgG1 constant region | ASTKGPSVFPLAPSSKSTSGGTAALGCLVKDYFPEP VTVSWNSGALTSGVHTFPAVLQSSGLYSLSSVVTV PSSSLGTQTYICNVNHKPSNTKVDKKVEPKSCDKT HTCPPCPAPELLGGPSVFLFPPKPKDTLMISRTPEVT CVVVDVSHEDPEVKFNWYVDGVEVHNAKTKPRE EQYNSTYRVVSVLTVLHQDWLNGKEYKCKVSNK ALPAPIEKTISKAKGQPREPQVYTLPPSRDELTKNQ VSLTCLVKGFYPSDIAVEWESNGQPENNYKTTPPV LDSDGSFFLYSKLTVDKSRWQQGNVFSCSVMHEA LHNHYTQKSLSLSPGK |
| 130 | IgG2 constant region | ASTKGPSVFP LAPCSRSTSE STAALGCLVK DYFPEPVTVS WNSGALTSGV HTFPAVLQSS GLYSLSSVVT VPSSNFGTQT YTCNVDHKPS NTKVDKTVER KCCVECP PCPAPPVAG PSVFLFPPKP KDTLMISRTP EVTCVVVDVS HEDPEVQFNW YVDGVEVHNA KTKPREEQFN STFRVVSVLT VVHQDWLNGK EYKCKVSNKG LPAPIEKTIS KTKGQPREPQ VYTLPPSREE MTKNQVSLTC LVKGFYPSDI AVEWESNGQP ENNYKTTPPM LDSDGSFFLY SKLTVDKSRW QQGNVFSCSV MHEALHNHYT QKSLSLSPGK |
| 131 | Human IgG1 kappa light chain (CL) | RTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| 132 | Heavy chain C-terminus | LSPGK |
| 133 | CD73.4-IgG2CS-IgG1.1f, AA sequence | QVQLVHSGGGVVQPGRSLRLSCAASGFTFSNYGM HWVRQAPGKGLEWVAVILYDGSNKYYPDSVKGR FTISRDNSKNTLYLQMNSLRAEDTAVYYCARGGSS WYPDSFDIWGQGTMVTVSSASTKGPSVFPLAPCSR STSESTAALGCLVKDYFPEPVTVSWNSGALTSGVH TFPAVLQSSGLYSLSSVVTVPSSNFGTQTYTCNVDH KPSNTKVDKTVERKSCVECPPCPAPPVAGPSVFLFP PKPKDTLMISRTPEVTCVVVDVSHEDPEVKFNWYV DGVEVHNAKTKPREEQYNSTYRVVSVLTVLHQDW LNGKEYKCKVSNKALPSSIEKTISKAKGQPREPQVY TLPPSREEMTKNQVSLTCLVKGFYPSDIAVEWESN GQPENNYKTTPPVLDSDGSFFLYSKLTVDKSRWQQ GNVFSCSVMHEALHNHYTQKSLSLSPGK |
| 134 | CD73.4-IgG2CS-IgG1.1f, NT sequence | caggtgcagctggtggagtctgggggaggcgtggtccagcctggggaggtcc ctgagactctcctgtgcagcctctggattcaccttcagtaactatggcatgcactg ggtccgccaggctccaggcaaggggctggagtgggtggcagttatattgtatga tggaagtaataaatactatccagactccgtgaaggggcgattcaccatctccaga gacaattccaagaacacgctgtatctgcaaatgaacagcctgagagccgagga cacggctgtgtattactgtgcgagaggggggcagcagctggtaccctgattcttttg atatctggggccaaggaacaatggtcaccgtctcttcagcgtcgaccaagggcc catccgtcttccccctggcgccctgctccaggagcacctccgagagcacagcg gccctgggctgcctggtcaaggactacttccccgaaccggtgacggtgtcgtgg aactcaggcgctctgaccagcggcgtgcacaccttcccagctgtcctacagtcct caggactctactccctcagcagcgtggtgaccgtgccctccagcaacttcggca cccagacctacacctgcaacgtagatcacaagcccagcaacaccaaggtggac aagacagttgagcgcaaatcctgtgtcgagtgcccaccgtgcccagcaccacct gtggcaggaccgtcagtcttcctcttccccccaaaacccaaggacaccctcatg atctcccggacccctgaggtcacatgcgtggtggtggacgtgagccacgaaga ccctgaggtcaagttcaactggtacgtggacggcgtggaggtgcataatgccaa gacaaagccgcgggaggagcagtacaacagcacgtaccgtgtggtcagcgtc ctcaccgtcctgcaccaggactggctgaatggcaaggagtacaagtgcaaggt ctccaacaaagccctcccaagcagcatcgagaaaaccatctccaaagccaaag ggcagccccgagaaccacaggtgtacaccctgcccccatcccgggaggagat |

TABLE 35-continued

| SEQ ID | Description | Sequence |
|---|---|---|
| | | gaccaagaaccaggtcagcctgacctgcctggtcaaaggcttctatcccagcga<br>catcgccgtggagtgggagagcaatgggcagccggagaacaactacaagacc<br>acgcctcccgtgctggactccgacggctccttcttcctctatagcaagctcaccgt<br>ggacaagagcaggtggcagcaggggaacgtcttctcatgctccgtgatgcatg<br>aggctctgcacaaccactacacgcagaagagcctctccctgtccccgggtaaa |
| 135 | CD73.4 VH(a.a.) | QVQLVESGGGVVQPGRSLRLSCAASGFTFSNYGM<br>HWVRQAPGKGLEWVAVILYDGSNKYYPDSVKGR<br>FTISRDNSKNTLYLQMNSLRAEDTAVYYCARGGSS<br>WYPDSFDIWGQGTMVTVSS |
| 136 | Wildtype IgG2 hinge | ERKCCVECPPCPAPPVAG |
| 137 | Wildtype IgG1 CH2 | PSVFLFPPKPKDTLMISRTPEVTCVVVDVSHEDPEV<br>KFNWYVDGVEVHNAKTKPREEQYNSTYRVVSVLT<br>VLHQDWLNGKEYKCKVSNKALPAPIEKTISKAK |
| 138 | Wildtype IgG1 CH3 | GQPREPQVYTLPPSREEMTKNQVSLTCLVKGFYPS<br>DIAVLWESNGQPLNNYKTTPPVLDSDGSFFLYSKL<br>TVDKSRWQQGNVFSCSVMHEALHNHYTQKSLSLS<br>PGK |
| 139 | 11F11 VH-Nucleotide Sequence | CAGGTGCAGCTGGTGGAGTCTGGGGGAGGCGTG<br>GTCCAGCCTGGGAGGTCCCTGAGACTCTCCTGTG<br>CAACGTCTGGATTCACCTTCAGTAACTATGGCAT<br>GCACTGGGTCCGCCAGGCTCCAGGCAAGGGGCT<br>GGAGTGGGTGGCAGTTATATTTATGATGGAAGT<br>AATAAATACTATCCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGGGGGCA<br>GCAGCTGGTACCCTGATTCTTTTGATATCTGGGG<br>CCAAGGAACAATGGTCACCGTCTC TTCA |
| 140 | 11F11 VK1-Nucleotide Sequence | GAAATTGTGTTGACACAGTCTCCAGCCACCCTGT<br>CTTTGTCTCCAGGGGAAAGAGCCACCCTCTCCTG<br>CAGGGCCAGTCAGGGTGTTAGCAGCTACTTAGCC<br>TGGTACCAGCAGAAACCTGGCCAGGCTCCCAGG<br>CTCCTCATCTATGATGCATCCAACAGGGCCACTG<br>GCATCCCAGCCAGGTTCAGTGGCAGTGGGCCTG<br>GGACAGACTTCACTCTCACCATCAGCAGCCTAGA<br>GCCTGAAGATTTTGCAGTTTATTACTGTCAGCAG<br>CGTAGCAACTGGCATCTCACTTTCGGCGG<br>AGGGACCAAGGTGGAGATCAAA |
| 141 | 11F11 VK2-Nucleotide Sequence | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCTCTCACTTTCGGCGG<br>AGGGACCAAGGTGGAGATCAAA |
| 142 | 4C3 VH-Nucleotide Sequence | GAAGTGCAGCTGGTGGAGTCTGGGGGAGGCTTG<br>GTACAGCCTGGCAGGTCCCTGAGACTCTCCTGTG<br>CAGCCTCTGGATTCACCTTTGATGATTATGCCAT<br>GCACTGGGTCCGGCAAGCTCCAGGGAAGGGCCT<br>GGAGTGGGTCTCAGGTATTAGTTGGAAGAGTGG<br>TAGCATAGGCTATGCGGACTCTGTGAAGGGCCG<br>ATTCACCATCTCCAGAGACAACGCCAAGAACTCC<br>CTGTATCTGCAAATGAACAGTCTGAGAGCTGAG<br>GACACGGCCTTGTATTACTGTGTAAAAGGGTATT<br>ACGTTATTTTGACTGGCCTTGACTACTGGGGCCA<br>GGGAACCCTGGTCACCGTCTCCTC A |
| 143 | 4C3 VK1-Nucleotide Sequence | GAAATTGTGTTGACGCAGTCTCCAGGCACCCTGT<br>CTTTGTCTCCAGGGGAAAGAGCCACCCTCTCCTG<br>CAGGGCCAGTCAGAGTGTTAGCAGCTACTTAGCC<br>TGGTACCAGCAGAAACCTGGCCAGGCTCCCAGG<br>CTCCTCATCTATGGTGCATCCAGCAGGGCCACTG<br>GCATCCCAGACAGGTTCAGTGGCAGTGGGTCTG<br>GGACAGACTTCACTCTCACCATCAGCAGACTGGA<br>GCCTGAAGATTTTGCAGTGTATTACTGTCAGCAG |

TABLE 35-continued

| SEQ ID | Description | Sequence |
|---|---|---|
| | | TATGGTAGCTCACCGCTCACTTTCGGCGGAGGGA<br>CCAAGGTGGAGATCAAA |
| 144 | 4C3 VK2-<br>Nucleotide<br>Sequence | GACATCCAGATGACCCAGTCTCCATCCTCACTGT<br>CTGCATCTGTAGGAGACAGAGTCACCTTCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCTCCAACGTTCGGCCA<br>GGGGACCAAGGTGGAAATCAAA |
| 145 | 4C3 VK3-<br>Nucleotide<br>Sequence | GACATCCAGATGACCCAGTCTCCATCCTCACTGT<br>CTGCATCTGTAGGAGACAGAGTCACCTTCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCTCCAACGTTCGGCCA<br>AGGGACCAAGGTGGAAATCAAA |
| 146 | 4D4 VH-<br>Nucleotide<br>Sequence | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAACTATGGCAT<br>GCACTGGGTCCGCCAGGCTCCAGGCAAGGGGCT<br>GGAGTGGGTGGCAGTTATATGGTATGATGAAAG<br>TAATAAATACTATGCAGACTCCGTGAAGGGCCG<br>ATTCACCATCTCCAGAGACAATTCCAAGAACACG<br>CTGTTTCTGCAAATGAACAGCCTGAGAGCCGAG<br>GACACGGCTGTGTATTATTGTGCGAGAGGGTATA<br>ACAGCAGGTGGTACCCTGATGCTTTTGATATCTG<br>GGGCCAAGGGACAATGGTCACCGT CTCTTCA |
| 147 | 4D4 VK1-<br>Nucleotide<br>Sequence | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCGCTCACTTTCGGCGGAGGGA<br>CCAAGGTGGAGATCAAA |
| 148 | 10D2 VH1-<br>Nucleotide<br>Sequence | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAACTATGGCCT<br>GCACTGGGTCCGCCAGGCTCCAGGCAAGGGGCT<br>GGAGTGGGTGGCAGTTATACGGTATGATGGAAG<br>TAATAAATACTATGCAGACTCCGTGAAGGGCCG<br>ATTCACCATCTCCAGAGACAATTCCAAGAACACG<br>CTGTATCTGCAAATGAGCAGCCTGAGAGCCGAG<br>GACACGGCTGTGTATTACTGTGCGAGGGGGGGC<br>AGCAGCTGGTACCCGGACGGTTTGGACGTCTGG<br>GGCCAAGGGACCACGGTCACCGTCTC CTCA |
| 149 | 10D2 VK1-<br>Nucleotide<br>Sequence | GCCATCCAGTTGACCCAGTCTCCATCCTCCCTGT<br>CTGCATCTGTAGGAGACAGAGTCACCATCACTTG<br>CCGGGCAAGTCAGGGCATTAGCAGTGCTTTAGCC<br>TGGTATCAGCAGAAACCAGGGAAAGCTCCTAAG<br>CTCCTGATCTATGATGCCTCCAGTTTGGAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGTCAACAG<br>TTTAATAGTTACCCCACTTTCGGCGGAGGGACCA<br>AGGTGGAGATCAAA |
| 150 | 10D2 VK2-<br>Nucleotide<br>Sequence | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG |

TABLE 35-continued

| SEQ ID | Description | Sequence |
|---|---|---|
| | | GGACAGATTTCACTCTCACCATCAGCAGCCTGCA GCCTGAAGATTTTGCAACTTATTACTGCCAACAG TATAATAGTTACCCGCTCACTTTCGGCGGAGGGA CCAAGGTGGAGATCAAA |
| 151 | 11A6 VH-Nucleotide Sequence | GAAGTGCAGCTGGTGGAATCTGGGGGAAACTTG GTACAGCCTGGCAGGTCCCTGAGACTCTCCTGTG CAGCCTCTGGATTCACCTTTGATGATTATGCCAT GCACTGGGTCCGGCAAGCTCCAGGGAAGGGCCT GGAGTGGGTCTCAGGTATTAGTTGGAATAATAAT GACATAGGCTATGCGGACTCTGTGAAGGGCCGA TTCATCATCTCCAGAGACAACGCCAAGAACTCCC TGTATCTGCAAATGAACAGTCTGAGACCTGAGG ACACGGCCTTGTATTATTGTGTAAAAGGTTATTA CGTTATTTTGACTGGTCTTGACTACTGGGGCCAG GGAACCCCGGTCACCGTCTCCTC A |
| 152 | 11A6 VK1-Nucleotide Sequence | GACATCCAGATGACCCAGTCTCCATCCTCACTGT CTGCATCTGTAGGAGACAGAGTCACCATCACTTG TCGGGCGAGTCAGGGTATTAGCAGCTGGTTAGCC TGGTATCAGCAGAAACCAGAGAAAGCCCCTAAG TCCCTGATCTATGCTGCATCCAGTTTGCAAAGTG GGGTCCCATCAAGGTTCAGCGGCAGTGGATCTG GGACAGATTTCACTCTCACCATCAGCAGCCTGCA GCCTGAAGATTTTGCAACTTATTACTGCCAACAG TATAATAGTTACCCGCTCACTTTCGGCGGAGGGA CCAAGGTGGAGATCAAA |
| 153 | 24H2 VH-Nucleotide Sequence | CAGGTGCAACTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGGAGG TAATAAATACTATGCAGACTCCGTGAAGGGCCG ATTCACCATCTCCAGAGACAATTCCAAGAACACG CTGTTTCTGCAAATGAACAGCCTGAGAGCCGAA GACACGGCTGTGTATTACTGTGCGAGAGGGGGC AGCAGCTGGTACCCTGATGCTTTTGATATCTGGG GCCAAGGGACAATGGTCACCGTCTC TTCA |
| 154 | 24H2 VK1-Nucleotide Sequence | GACATCCAGATGACCCAGTCTCCATCCTCACTGT CTGCATCTGTAGGAGACAGAGTCACCATCACTTG TCGGGCGAGTCAGGGTATTAGCAGCTGGTTAGCC TGGTATCAGCAGAAACCAGAGAAAGCCCCTAAG TCCCTGATCTATGCTGCATCCAGTTTGCAAAGTG GGGTCCCATCAAGGTTCAGCGGCAGTGGATCTG GGACAGATTTCACTCTCACCATCAGCAGCCTGCA GCCTGAAGATTTTGCAACTTATTACTGCCAACAG TATAATAGTTACCCTCTCACTTTCGGCGGAGGGA CCAAGGTGGAGATCAAA |
| 155 | 5F8 VH-Nucleotide Sequence | GAGGTGCAGCTGGTGGAGTCCGGGGGAGGCTTA GTTCAGCCTGGGGGGTCCCTGAGACTCTCCTGTG CAGCCTCTGGATTCACCTTCAGTAGCTACTGGAT GCACTGGGTCCGCCAAGCTCCAGGGAAGGGGCT GGTGTGGGTCTCACGTATTATTAGTGATGGGAGT AGCACAGGTTACGCGGATTCCGTGAAGGGCCGA TTCACCATCTCCAGAGACAACGCCAAGAACACG CTGTATCTGCAAATGAACAGTCTGAGAGCCGAG GACACGGCTGTGTATTACTGTGCAAGAGAGTTTA GCAGTGGCTGGTACTTTGACTACTGGGGCCAGGG AACCCTGGTCACCGTCTCCTCA |
| 156 | 5F8 VK1-Nucleotide Sequence | GCCATCCAGTTGACCCAGTCTCCATCCTCCCTGT CTGCATCTGTAGGAGACAGAGTCACCATCACTTG CCGGGCAAGTCAGGGCATTAGCAGTGCTTTAGCC TGGTATCAGCAGAAACCAGGGAAAGCTCCTAAG CTCCTGATCTATGATGCCTCCAGTTTGGAAAGTG GGGTCCCATCAAGGTTCAGCGGCAGTGGATCTG GGACAGATTTCACTCTCACCATCAGCAGCCTGCA GCCTGAAGATTTTGCAACTTATTACTGTCAACAG TTTAGTAGTTACCCTCGGACGTTCGGCCAAGGGA CCAAGGTGGAAATCAAA |

TABLE 35-continued

| SEQ ID | Description | Sequence |
|---|---|---|
| 157 | 5F8 VK2-Nucleotide Sequence | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGGTTTCACTCTCACCATCAGCAGCCTGCA<br>GCCTGAAGATTTTGCAACTTATTACTGCCAACAG<br>TATAATAGTTACCCTCGGACGTTCGGCCAAGGGA<br>CCAAGGTGGAAATCAAA |
| 158 | 6E11 VH-Nucleotide Sequence | GAAGTGCAGCTGGTGGAGTCTGGGGGAGCCTTG<br>GTACAGCCTGGCAGGTCCCTGAGACTCTCCTGTG<br>CAGCCTCTGGATTCACCTTTGATGATTATGCCAT<br>GCACTGGGTCCGGCAAGCTCCAGGGAAGGGCCT<br>GGAGTGGGTCTCAGGTATTACTTGGAATAGTGGT<br>GGCATAGGCTACGCGGACTCTGTGAAGGGCCGA<br>TTCACCATCTCCAGAGACAACGCCAAGAACTCCC<br>TGTATCTGCAAATGAACAGTCTGAGAGCTGAGG<br>ACACGGCCTTGTATTACTGTGCAAAAGATAGGTA<br>TTACAGCAGTTGGCTCCTCTTTGACAACTGGGGC<br>CAGGGAATTCTGGTCACCGTCTC CTCA |
| 159 | 6E11 VK1-Nucleotide Sequence | GAAATTGTGTTGACGCAGTCTCCAGGCACCCTGT<br>CTTTGTCTCCAGGGGAAAGAGCCACCCTCTCCTG<br>CAGGGCCAGTCAGAGTGTTAGCAGCAGCTACTT<br>AGCCTGGTACCAGCAGAAACCTGGCCAGGCTCC<br>CAGGCTCCTCATCTATGGTGCATCCAGCAGGGCC<br>ACTGGCATCCCAGACAGGTTCAGTGGCAGTGGG<br>TCTGGGACAGACTTCACTCTCACCATCAGCAGAC<br>TGGAGCCTGAAGATTTTGCAGTGTATTACTGTCA<br>GCATTATGGTAGCTCATTCACTTTCGGCCCTGGG<br>ACCAAAGTGGATATCAAA |
| 160 | 7A11 VH-Nucleotide Sequence | GAAGTGCAGCTGGTGGAGTCTGGGGGAGGCTTG<br>GTACAGCTGGCAGGTCCCTGAGACTCTCCTGTG<br>CAGCCTCTGGATTCACCTTTGATGATTATGCCAT<br>GCACTGGGTCCGGCAAGCTCCAGGGAAGGGCCT<br>GGAGTGGGTCTCAGATATTAGTTGGAATAGTGAT<br>ATTATAGGCTATGCGGACTCTGTGAAGGGCCGAT<br>TCACCATCTCTAGAGACAACGCCAAGAACTCCCT<br>GTATCTGCAAATGAACAGTCTGAGAGCTGAGGA<br>CACGGCCTTGTATTACTGTGCAAAAGATATTTAT<br>GGTTCGGGGAGTTCTTTTTTTGACTACTGGGGCC<br>AGGGAATCCTGGTCACCGTCTC CTCA |
| 161 | 7A11 VK1-Nucleotide Sequence | GACATCCAGATGACCCAGTCTCCATCCTCACTGT<br>CTGCATCTGTAGGAGACAGAGTCACCATCACTTG<br>TCGGGCGAGTCAGTATATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATCATAGTTACCCTCCCACCTTCGGCCA<br>AGGGACACGACTGGAGATTAAA |
| 162 | IgG1-IgG2-IgG1f2 (MHCCR) | ASTKGPSVFPLAPSSKSTSGGTAALGCLVKDYFPEP<br>VTVSWNSGALTSGVHTFPAVLQSSGLYSLSSVVTV<br>PSSSLGTQTYICNVNHKPSNTKVDKKV<u>ERKCCVEC</u><br><u>PPCPAPPVAG</u>PSVFLFPPKPKDTLMISRTPEVTCVV<br>VDVSHEDPEVKFNWYVDGVEVHNAKTKPREEQY<br>NSTYRVVSVLTVLHQDWLNGKEYKCKVSNKALPA<br>PIEKTISKAKGQPREPQVYTLPPSREEMTKNQVSLT<br>CLVKGFYPSDIAVEWESNGQPENNYKTTPPVLDSD<br>GSFFLYSKLTVDKSRWQQGNVFSCSVMHEALHNH<br>YTQKSLSLSPGK |
| 163 | IgG1-IgG2CS-IgG1f2 (MHCCR) | ASTKGPSVFPLAPSSKSTSGGTAALGCLVKDYFPEP<br>VTVSWNSGALTSGVHTFPAVLQSSGLYSLSSVVTV<br>PSSSLGTQTYICNVNHKPSNTKVDKKV<u>ERKSCVEC</u><br><u>PPCPAPPVAG</u>PSVFLFPPKPKDTLMISRTPEVTCVV<br>VDVSHEDPEVKFNWYVDGVEVHNAKTKPREEQY<br>NSTYRVVSVLTVLHQDWLNGKEYKCKVSNKALPA<br>PIEKTISKAKGQPREPQVYTLPPSREEMTKNQVSLT<br>CLVKGFYPSDIAVEWESNGQPENNYKTTPPVLDSD |

TABLE 35-continued

| SEQ ID | Description | Sequence |
|---|---|---|
| | | GSFFLYSKLTVDKSRWQQGNVFSCSVMHEALHNH YTQKSLSLSPGK |
| 164 | IgG2-IgG1f2 (MHCCR) | ASTKGPSVFPLAPCSRSTSESTAALGCLVKDYFPEP VTVSWNSGALTSGVHTFPAVLQSSGLYSLSSVVTV PSSNFGTQTYTCNVDHKPSNTKVDKTV<u>ERKCCVEC PPCPAPPVAG</u>PSVFLFPPKPKDTLMISRTPEVTCVV VDVSHEDPEVKFNWYVDGVEVHNAKTKPREEQY NSTYRVVSVLTVLHQDWLNGKEYKCKVSNKALPA PIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 165 | IgG2CS-IgG1f2 (MHCCR) | ASTKGPSVFPLAPCSRSTSESTAALGCLVKDYFPEP VTVSWNSGALTSGVHTFPAVLQSSGLYSLSSVVTV PSSNFGTQTYTCNVDHKPSNTKVDKTV<u>ERKSCVEC PPCPAPPVAG</u>PSVFLFPPKPKDTLMISRTPEVTCVV VDVSHEDPEVKFNWYVDGVEVHNAKTKPREEQY NSTYRVVSVLTVLHQDWLNGKEYKCKVSNKALPA PIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 166 | IgG1-IgG2-IgG1.1f (MHCCR) | ASTKGPSVFPLAPSSKSTSGGTAALGCLVKDYFPEP VTVSWNSGALTSGVHTFPAVLQSSGLYSLSSVVTV PSSSLGTQTYICNVNHKPSNTKVDKKV<u>ERKCCVEC PPCPAPPVAG</u>PSVFLFPPKPKDTLMISRTPEVTCVV VDVSHEDPEVKFNWYVDGVEVHNAKTKPREEQY NSTYRVVSVLTVLHQDWLNGKEYKCKVSNKALPS SIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 167 | IgG1-IgG2CS-IgG1.1f (MHCCR) | ASTKGPSVFPLAPSSKSTSGGTAALGCLVKDYFPEP VTVSWNSGALTSGVHTFPAVLQSSGLYSLSSVVTV PSSSLGTQTYICNVNHKPSNTKVDKKV<u>ERKSCVEC PPCPAPPVAG</u>PSVFLFPPKPKDTLMISRTPEVTCVV VDVSHEDPEVKFNWYVDGVEVHNAKTKPREEQY NSTYRVVSVLTVLHQDWLNGKEYKCKVSNKALPS SIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 168 | IgG2-IgG1.1f (MHCCR) | ASTKGPSVFPLAPCSRSTSESTAALGCLVKDYFPEP VTVSWNSGALTSGVHTFPAVLQSSGLYSLSSVVTV PSSNFGTQTYTCNVDHKPSNTKVDKTV<u>ERKCCVEC PPCPAPPVAG</u>PSVFLFPPKPKDTLMISRTPEVTCVV VDVSHEDPEVKFNWYVDGVEVHNAKTKPREEQY NSTYRVVSVLTVLHQDWLNGKEYKCKVSNKALPS SIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 169 | IgG2CS-IgG1.1f (MHCCR) | ASTKGPSVFPLAPCSRSTSESTAALGCLVKDYFPEP VTVSWNSGALTSGVHTFPAVLQSSGLYSLSSVVTV PSSNFGTQTYTCNVDHKPSNTKVDKTV<u>ERKSCVEC PPCPAPPVAG</u>PSVFLFPPKPKDTLMISRTPEVTCVV VDVSHEDPEVKFNWYVDGVEVHNAKTKPREEQY NSTYRVVSVLTVLHQDWLNGKEYKCKVSNKALPS SIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 170 | CD73.3 VH (a.a) | EVQLVESGGGLVQPGRSLRLSCAASGFTFDDYAM HWVRQAPGKGLEWVSGISWKSGSIGYADSVKGRF TISRDNAKNSLYLQMNSLRAEDTVLYYCVKGYYVI LTGLDYWGQGTLVTVSS |
| 171 | CD73.5 VH (a.a) | QVQLVESGGGVVQPGRSLRLSCASSGFTFSNYGMH WVRQAPGKGLEWVAVILYDGSNKYYPDSVKGRFT |

TABLE 35-continued

| SEQ ID | Description | Sequence |
|---|---|---|
| | | ISRDNSKNTLYLQMNSLRAEDTAVYYCARGGSSW YPDSFDIWGQGTMVTVSS |
| 172 | CD73.6 VH (a.a) | QVQLVESGGGVVQPGRSLRLSCAASGFTFSNYGM HWVRQAPGKGLEWVAVILYDSSNKYYPDSVKGRF TISRDNSKNTLYLQMNSLRAEDTAVYYCARGGSS WYPDSFDIWGQGTMVTVSS |
| 173 | CD73.7 VH (a.a) | QVQLVESGGGVVQPGRSLRLSCASSGFTFSNYGMH WVRQAPGKGLEWVAVILYDSSNKYYPDSVKGRFT ISRDNSKNTLYLQMNSLRAEDTAVYYCARGGSSW YPDSFDIWGQGTMVTVSS |
| 174 | CD73.8 VH (a.a) | QVQLVESGGGVVQPGRSLRLSCAASGFTFSNYGM HWVRQAPGKGLEWVAVIWYDSSNKYYPDSVKGR FTISRDNSKNTLYLQMNSLRAEDTAVYYCARGGSS WYPDSFDIWGQGTMVTVSS |
| 175 | CD73.9 VH (a.a) | QVQLVESGGGVVQPGRSLRLSCASSGFTFSNYGMH WVRQAPGKGLEWVAVIWYDSSNKYYPDSVKGRF TISRDNSKNTLYLQMNSLRAEDTAVYYCARGGSS WYPDSFDIWGQGTMVTVSS |
| 176 | CD73.10 VH (a.a) | QVQLVESGGGVVQPGRSLRLSCAASGFTFSNYGM HWVRQAPGKGLEWVAVIWYDESNKYYPDSVKGR FTISRDNSKNTLYLQMNSLRAEDTAVYYCARGGSS WYPDSFDIWGQGTMVTVSS |
| 177 | CD73.11 VH (a.a) | QVQLVESGGGVVQPGRSLRLSCAASGFTFSNYGM HWVRQAPGKGLEWVAVIWYDESNKYYADSVKGR FTISRDNSKNTLFLQMNSLRAEDTAVYYCARGYNS RWYPDAFDIWGQGTMVTVSS |
| 178 | IgG2/IgG1 hybrid hinge | ERKCCVECPPCPAPELLGG |
| 179 | IgG2 C219S/IgG1 hybrid hinge | ERKSCVECPPCPAPELLGG |
| 180 | IgG1-IgG2-IgG1f | ASTKGPSVFPLAPSSKSTSGGTAALGCLVKDYFPEP VTVSWNSGALTSGVHTFPAVLQSSGLYSLSSVVTV PSSSLGTQTYICNVNHKPSNTKVDKKVERKCCVEC PPCPAPELLGGPSVFLFPPKPKDTLMISRTPEVTCVV VDVSHEDPEVKFNWYVDGVEVHNAKTKPREEQY NSTYRVVSVLTVLHQDWLNGKEYKCKVSNKALPA PIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 181 | IgG1-IgG2CS-IgG1f | ASTKGPSVFPLAPSSKSTSGGTAALGCLVKDYFPEP VTVSWNSGALTSGVHTFPAVLQSSGLYSLSSVVTV PSSSLGTQTYICNVNHKPSNTKVDKKVERKSCVEC PPCPAPELLGGPSVFLFPPKPKDTLMISRTPEVTCVV VDVSHEDPEVKFNWYVDGVEVHNAKTKPREEQY NSTYRVVSVLTVLHQDWLNGKEYKCKVSNKALPA PIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 182 | IgG2-IgG1f | ASTKGPSVFPLAPCSRSTSESTAALGCLVKDYFPEP VTVSWNSGALTSGVHTFPAVLQSSGLYSLSSVVTV PSSNFGTQTYTCNVDHKPSNTKVDKTVERKCCVEC PPCPAPELLGGPSVFLFPPKPKDTLMISRTPEVTCVV VDVSHEDPEVKFNWYVDGVEVHNAKTKPREEQY NSTYRVVSVLTVLHQDWLNGKEYKCKVSNKALPA PIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 183 | IgG2CS-IgG1f | ASTKGPSVFPLAPCSRSTSESTAALGCLVKDYFPEP VTVSWNSGALTSGVHTFPAVLQSSGLYSLSSVVTV PSSNFGTQTYTCNVDHKPSNTKVDKTVERKSCVEC PPCPAPELLGGPSVFLFPPKPKDTLMISRTPEVTCVV VDVSHEDPEVKFNWYVDGVEVHNAKTKPREEQY NSTYRVVSVLTVLHQDWLNGKEYKCKVSNKALPA |

TABLE 35-continued

| SEQ ID | Description | Sequence |
|---|---|---|
| | | PIEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNH YTQKSLSLSPGK |
| 184 | mAb-CD73.3-Vh-hHC-IgG1.1f | EVQLVESGGG LVQPGRSLRL SCAASGFTFD DYAMHWVRQA PGKGLEWVSGISWKSGSIGY ADSVKGRFTI SRDNAKNSLY LQMNSLRAED TALYYCAKGYYVILTGLDYW GQGTLVTVSS ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKRVEP KSCDKTHTCP PCPAPEAEGA PSVFLFPPKP KDTLMISRTP EVTCVVVDVS HEDPEVKFNW YVDGVEVHNA KTKPREEQYN STYRVVSVLT VLHQDWLNGK EYKCKVSNKA LPSSIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV MHEALHNHYT QKSLSLSPG |
| 185 | mAb-CD73.3-Vh-hHC-IgG2-C219S | EVQLVESGGG LVQPGRSLRL SCAASGFTFD DYAMHWVRQA PGKGLEWVSG ISWKSGSIGY ADSVKGRFTI SRDNAKNSLY LQMNSLRAED TALYYCAKGY YVILTGLDYW GQGTLVTVSS ASTKGPSVFP LAPCSRSTSE STAALGCLVK DYFPEPVTVS WNSGALTSGV HTFPAVLQSS GLYSLSSVVT VPSSNFGTQT YTCNVDHKPS NTKVDKTVER KSCVECPPCP APPVAGPSVF LFPPKPKDTL MISRTPEVTC VVVDVSHEDP EVQFNWYVDG VEVHNAKTKP REEQFNSTFR VVSVLTVVHQ DWLNGKEYKC KVSNKGLPAP IEKTISKTKG QPREPQVYTL PPSREEMTKN QVSLTCLVKG FYPSDIAVEW ESNGQPENNY KTTPPMLDSD GSFFLYSKLT VDKSRWQQGN VFSCSVMHEA LHNHYTQKSL SLSPG |
| 186 | mAb-CD73.3-Vh-hHC-IgG2-C219S-IgG1.1f | EVQLVESGGG LVQPGRSLRL SCAASGFTFD DYAMHWVRQA PGKGLEWVSG ISWKSGSIGY ADSVKGRFTI SRDNAKNSLY LQMNSLRAED TALYYCAKGY YVILTGLDYW GQGTLVTVSS ASTKGPSVFP LAPCSRSTSE STAALGCLVK DYFPEPVTVS WNSGALTSGV HTFPAVLQSS GLYSLSSVVT VPSSNFGTQT YTCNVDHKPS NTKVDKTVER KSCVECPPCP APPVAGPSVF LFPPKPKDTL MISRTPEVTC VVVDVSHEDP EVKFNWYVDG VEVHNAKTKP REEQYNSTYR VVSVLTVLHQ DWLNGKEYKC KVSNKALPSS IEKTISKAKG QPREPQVYTL PPSREEMTKN QVSLTCLVKG FYPSDIAVEW ESNGQPENNY KTTPPVLDSD GSFFLYSKLT VDKSRWQQGN VFSCSVMHEA LHNHYTQKSL SLSPG |
| 187 | mAb-CD73.4-Vh-hHC-IgG1.1f | QVQLVESGGG VVQPGRSLRL SCAASGFTFS NYGMHWVRQA PGKGLEWVAV ILYDGSNKYY PDSVKGRFTI SRDNSKNTLY LQMNSLRAED TAVYYCARGG SSWYPDSFDI WGQGTMVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKRVE PKSCDKTHTC PPCPAPEAEG APSVFLFPPK PKDTLMISRT PEVTCVVVDV SHEDPEVKFN WYVDGVEVHN AKTKPREEQY NSTYRVVSVL TVLHQDWLNG KEYKCKVSNK ALPSSIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG |
| 188 | mAb-CD73.4-Vh-hHC-IgG2-C219S | QVQLVESGGG VVQPGRSLRL SCAASGFTFS NYGMHWVRQA PGKGLEWVAV ILYDGSNKYY PDSVKGRFTI SRDNSKNTLY LQMNSLRAED TAVYYCARGG SSWYPDSFDI WGQGTMVTVS SASTKGPSVF PLAPCSRSTS ESTAALGCLV KDYFPEPVTV SWNSGALTSG VHTFPAVLQS SGLYSLSSVV TVPSSNFGTQ TYTCNVDHKP SNTKVDKTVE RKSCVECPPC PAPPVAGPSV |

TABLE 35-continued

| SEQ ID Description | Sequence |
|---|---|
| | FLFPPKPKDT LMISRTPEVT CVVVDVSHED<br>PEVQFNWYVD GVEVHNAKTK PREEQFNSTF<br>RVVSVLTVVH QDWLNGKEYK CKVSNKGLPA<br>PIEKTISKTK GQPREPQVYT LPPSREEMTK<br>NQVSLTCLVK GFYPSDIAVE WESNGQPENN<br>YKTTPPMLDS DGSFFLYSKL TVDKSRWQQG<br>NVFSCSVMHE ALHNHYTQKS LSLSPG |
| 189 mAb-CD73.4-Vh-<br>hHC-IgG2-C219S-<br>IgG1.1f<br>(identical to<br>SEQ ID NO: 133,<br>except lacks C-<br>terminal lysine) | QVQLVESGGG VVQPGRSLRL SCAASGFTFS<br>NYGMHWVRQA PGKGLEWVAV ILYDGSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVKFNWYVD GVEVHNAKTK PREEQYNSTY<br>RVVSVLTVLH QDWLNGKEYK CKVSNKALPS<br>SIEKTISKAK GQPREPQVYT LPPSREEMTK<br>NQVSLTCLVK GFYPSDIAVE WESNGQPENN<br>YKTTPPVLDS DGSFFLYSKL TVDKSRWQQG<br>NVFSCSVMHE ALHNHYTQKS LSLSPG |
| 190 mAb-CD73.5-Vh-<br>hHC-IgG1.1f | QVQLVESGGG VVQPGRSLRL SCASSGFTFS<br>NYGMHWVRQA PGKGLEWVAV ILYDGSNKYY<br>PDSVKGRFTI SRDNSKNTLY LQMNSLRAED<br>TAVYYCARGG SSWYPDSFDI WGQGTMVTVS<br>SASTKGPSVF PLAPSSKSTS GGTAALGCLV<br>KDYFPEPVTV SWNSGALTSG VHTFPAVLQS<br>SGLYSLSSVV TVPSSSLGTQ TYICNVNHKP<br>SNTKVDKRVE PKSCDKTHTC PPCPAPEAEG<br>APSVFLFPPK PKDTLMISRT PEVTCVVVDV<br>SHEDPEVKFN WYVDGVEVHN AKTKPREEQY<br>NSTYRVVSVL TVLHQDWLNG KEYKCKVSNK<br>ALPSSIEKTI SKAKGQPREP QVYTLPPSRE<br>EMTKNQVSLT CLVKGFYPSD IAVEWESNGQ<br>PENNYKTTPP VLDSDGSFFL YSKLTVDKSR<br>WQQGNVFSCS VMHEALHNHY TQKSLSLSPG |
| 191 mAb-CD73.5-Vh-<br>hHC-IgG2-C219S | QVQLVESGGG VVQPGRSLRL SCASSGFTFS<br>NYGMHWVRQA PGKGLEWVAV ILYDGSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVQFNWYVD GVEVHNAKTK PREEQFNSTF<br>RVVSVLTVVH QDWLNGKEYK CKVSNKGLPA<br>PIEKTISKTK GQPREPQVYT LPPSREEMTK<br>NQVSLTCLVK GFYPSDIAVE WESNGQPENN<br>YKTTPPMLDS DGSFFLYSKL TVDKSRWQQG<br>NVFSCSVMHE ALHNHYTQKS LSLSPG |
| 192 mAb-CD73.5-Vh-<br>hHC-IgG2-C219S-<br>IgG1.1f | QVQLVESGGG VVQPGRSLRL SCASSGFTFS<br>NYGMHWVRQA PGKGLEWVAV ILYDGSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVKFNWYVD GVEVHNAKTK PREEQYNSTY<br>RVVSVLTVLH QDWLNGKEYK CKVSNKALPS<br>SIEKTISKAK GQPREPQVYT LPPSREEMTK<br>NQVSLTCLVK GFYPSDIAVE WESNGQPENN<br>YKTTPPVLDS DGSFFLYSKL TVDKSRWQQG<br>NVFSCSVMHE ALHNHYTQKS LSLSPG |
| 193 mAb-CD73.6-Vh-<br>hHC-IgG1.1f | QVQLVESGGG VVQPGRSLRL SCAASGFTFS<br>NYGMHWVRQA PGKGLEWVAV ILYDSSNKYY<br>PDSVKGRFTI SRDNSKNTLY LQMNSLRAED<br>TAVYYCARGG SSWYPDSFDI WGQGTMVTVS<br>SASTKGPSVF PLAPSSKSTS GGTAALGCLV |

| SEQ ID | Description | Sequence |
|---|---|---|
| | | KDYFPEPVTV SWNSGALTSG VHTFPAVLQS<br>SGLYSLSSVV TVPSSSLGTQ TYICNVNHKP<br>SNTKVDKRVE PKSCDKTHTC PPCPAPEAEG<br>APSVFLFPPK PKDTLMISRT PEVTCVVVDV<br>SHEDPEVKFN WYVDGVEVHN AKTKPREEQY<br>NSTYRVVSVL TVLHQDWLNG KEYKCKVSNK<br>ALPSSIEKTI SKAKGQPREP QVYTLPPSRE<br>EMTKNQVSLT CLVKGFYPSD IAVEWESNGQ<br>PENNYKTTPP VLDSDGSFFL YSKLTVDKSR<br>WQQGNVFSCS VMHEALHNHY TQKSLSLSPG |
| 194 | mAb-CD73.6-Vh-hHC-IgG2-C219S | QVQLVESGGG VVQPGRSLRL SCAASGFTFS<br>NYGMHWVRQA PGKGLEWVAV ILYDSSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVQFNWYVD GVEVHNAKTK PREEQFNSTF<br>RVVSVLTVVH QDWLNGKEYK CKVSNKGLPA<br>PIEKTISKTK GQPREPQVYT LPPSREEMTK<br>NQVSLTCLVK GFYPSDIAVE WESNGQPENN<br>YKTTPPMLDS DGSFFLYSKL TVDKSRWQQG<br>NVFSCSVMHE ALHNHYTQKS LSLSPG |
| 195 | mAb-CD73.6-Vh-hHC-IgG2-C219S-IgG1.1f | QVQLVESGGG VVQPGRSLRL SCAASGFTFS<br>NYGMHWVRQA PGKGLEWVAV ILYDSSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVKFNWYVD GVEVHNAKTK PREEQYNSTY<br>RVVSVLTVLH QDWLNGKEYK CKVSNKALPS<br>SIEKTISKAK GQPREPQVYT LPPSREEMTK<br>NQVSLTCLVK GFYPSDIAVE WESNGQPENN<br>YKTTPPVLDS DGSFFLYSKL TVDKSRWQQG<br>NVFSCSVMHE ALHNHYTQKS LSLSPGK |
| 196 | mAb-CD73.7-Vh-hHC-IgG1.1f | QVQLVESGGG VVQPGRSLRL SCASSGFTFS<br>NYGMHWVRQA PGKGLEWVAV ILYDSSNKYY<br>PDSVKGRFTI SRDNSKNTLY LQMNSLRAED<br>TAVYYCARGG SSWYPDSFDI WGQGTMVTVS<br>SASTKGPSVF PLAPSSKSTS GGTAALGCLV<br>KDYFPEPVTV SWNSGALTSG VHTFPAVLQS<br>SGLYSLSSVV TVPSSSLGTQ TYICNVNHKP<br>SNTKVDKRVE PKSCDKTHTC PPCPAPEAEG<br>APSVFLFPPK PKDTLMISRT PEVTCVVVDV<br>SHEDPEVKFN WYVDGVEVHN AKTKPREEQY<br>NSTYRVVSVL TVLHQDWLNG KEYKCKVSNK<br>ALPSSIEKTI SKAKGQPREP QVYTLPPSRE<br>EMTKNQVSLT CLVKGFYPSD IAVEWESNGQ<br>PENNYKTTPP VLDSDGSFFL YSKLTVDKSR<br>WQQGNVFSCS VMHEALHNHY TQKSLSLSPG |
| 197 | mAb-CD73.7-Vh-hHC-IgG2-C219S | QVQLVESGGG VVQPGRSLRL SCASSGFTFS<br>NYGMHWVRQA PGKGLEWVAV ILYDSSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVQFNWYVD GVEVHNAKTK PREEQFNSTF<br>RVVSVLTVVH QDWLNGKEYK CKVSNKGLPA<br>PIEKTISKTK GQPREPQVYT LPPSREEMTK<br>NQVSLTCLVK GFYPSDIAVE WESNGQPENN<br>YKTTPPMLDS DGSFFLYSKL TVDKSRWQQG<br>NVFSCSVMHE ALHNHYTQKS LSLSPG |

TABLE 35-continued

| SEQ ID | Description | Sequence |
|---|---|---|
| 198 | mAb-CD73.7-Vh-hHC-IgG2-C219S-IgG1.1f | QVQLVESGGG VVQPGRSLRL SCASSGFTFS NYGMHWVRQA PGKGLEWVAV ILYDSSNKYY PDSVKGRFTI SRDNSKNTLY LQMNSLRAED TAVYYCARGG SSWYPDSFDI WGQGTMVTVS SASTKGPSVF PLAPCSRSTS ESTAALGCLV KDYFPEPVTV SWNSGALTSG VHTFPAVLQS SGLYSLSSVV TVPSSNFGTQ TYTCNVDHKP SNTKVDKTVE RKSCVECPPC PAPPVAGPSV FLFPPKPKDT LMISRTPEVT CVVVDVSHED PEVKFNWYVD GVEVHNAKTK PREEQYNSTY RVVSVLTVLH QDWLNGKEYK CKVSNKALPS SIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPG |
| 199 | mAb-CD73.8-Vh-hHC-IgG1.1f | QVQLVESGGG VVQPGRSLRL SCAASGFTFS NYGMHWVRQA PGKGLEWVAV IWYDSSNKYY PDSVKGRFTI SRDNSKNTLY LQMNSLRAED TAVYYCARGG SSWYPDSFDI WGQGTMVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKRVE PKSCDKTHTC PPCPAPEAEG APSVFLFPPK PKDTLMISRT PEVTCVVVDV SHEDPEVKFN WYVDGVEVHN AKTKPREEQY NSTYRVVSVL TVLHQDWLNG KEYKCKVSNK ALPSSIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG |
| 200 | mAb-CD73.8-Vh-hHC-IgG2-C219S | QVQLVESGGG VVQPGRSLRL SCAASGFTFS NYGMHWVRQA PGKGLEWVAV IWYDSSNKYY PDSVKGRFTI SRDNSKNTLY LQMNSLRAED TAVYYCARGG SSWYPDSFDI WGQGTMVTVS SASTKGPSVF PLAPCSRSTS ESTAALGCLV KDYFPEPVTV SWNSGALTSG VHTFPAVLQS SGLYSLSSVV TVPSSNFGTQ TYTCNVDHKP SNTKVDKTVE RKSCVECPPC PAPPVAGPSV FLFPPKPKDT LMISRTPEVT CVVVDVSHED PEVQFNWYVD GVEVHNAKTK PREEQFNSTF RVVSVLTVVH QDWLNGKEYK CKVSNKGLPA PIEKTISKTK GQPREPQVYT LPPSREEMTK NQVSLTCLVK GFYPSDIAVE WESNGQPENN YKTTPPMLDS DGSFFLYSKL TVDKSRWQQG NVFSCSVMHE ALHNHYTQKS LSLSPG |
| 201 | mAb-CD73.8-Vh-hHC-IgG2-C219S-IgG1.1f | QVQLVESGGG VVQPGRSLRL SCAASGFTFS NYGMHWVRQA PGKGLEWVAV IWYDSSNKYY PDSVKGRFTI SRDNSKNTLY LQMNSLRAED TAVYYCARGG SSWYPDSFDI WGQGTMVTVS SASTKGPSVF PLAPCSRSTS ESTAALGCLV KDYFPEPVTV SWNSGALTSG VHTFPAVLQS SGLYSLSSVV TVPSSNFGTQ TYTCNVDHKP SNTKVDKTVE RKSCVECPPC PAPPVAGPSV FLFPPKPKDT LMISRTPEVT CVVVDVSHED PEVKFNWYVD GVEVHNAKTK PREEQYNSTY RVVSVLTVLH QDWLNGKEYK CKVSNKALPS SIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPG |
| 202 | mAb-CD73.9-Vh-hHC-IgG1.1f | QVQLVESGGG VVQPGRSLRL SCASSGFTFS NYGMHWVRQA PGKGLEWVAV IWYDSSNKYY PDSVKGRFTI SRDNSKNTLY LQMNSLRAED TAVYYCARGG SSWYPDSFDI WGQGTMVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKRVE PKSCDKTHTC PPCPAPEAEG APSVFLFPPK PKDTLMISRT PEVTCVVVDV SHEDPEVKFN WYVDGVEVHN AKTKPREEQY NSTYRVVSVL TVLHQDWLNG KEYKCKVSNK ALPSSIEKTI SKAKGQPREP QVYTLPPSRE |

| SEQ ID | Description | Sequence |
|---|---|---|
| | | EMTKNQVSLT CLVKGFYPSD IAVEWESNGQ<br>PENNYKTTPP VLDSDGSFFL YSKLTVDKSR<br>WQQGNVFSCS VMHEALHNHY TQKSLSLSPG |
| 203 | mAb-CD73.9-Vh-<br>hHC-IgG2-C219S | QVQLVESGGG VVQPGRSLRL SCASSGFTFS<br>NYGMHWVRQA PGKGLEWVAV IWYDSSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVQFNWYVD GVEVHNAKTK PREEQFNSTF<br>RVVSVLTVVH QDWLNGKEYK CKVSNKGLPA<br>PIEKTISKTK GQPREPQVYT LPPSREEMTK<br>NQVSLTCLVK GFYPSDIAVE WESNGQPENN<br>YKTTPPMLDS DGSFFLYSKL TVDKSRWQQG<br>NVFSCSVMHE ALHNHYTQKS LSLSPG |
| 204 | mAb-CD73.9-Vh-<br>hHC-IgG2-C219S-<br>IgG1.1f | QVQLVESGGG VVQPGRSLRL SCASSGFTFS<br>NYGMHWVRQA PGKGLEWVAV IWYDSSNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVKFNWYVD GVEVHNAKTK PREEQYNSTY<br>RVVSVLTVLH QDWLNGKEYK CKVSNKALPS<br>SIEKTISKAK GQPREPQVYT LPPSREEMTK<br>NQVSLTCLVK GFYPSDIAVE WESNGQPENN<br>YKTTPPVLDS DGSFFLYSKL TVDKSRWQQG<br>NVFSCSVMHE ALHNHYTQKS LSLSPG |
| 205 | mAb-CD73.10-Vh-<br>hHC-IgG1.1f | QVQLVESGGG VVQPGRSLRL SCAASGFTFS<br>NYGMHWVRQA PGKGLEWVAV IWYDESNKYY<br>PDSVKGRFTI SRDNSKNTLY LQMNSLRAED<br>TAVYYCARGG SSWYPDSFDI WGQGTMVTVS<br>SASTKGPSVF PLAPSSKSTS GGTAALGCLV<br>KDYFPEPVTV SWNSGALTSG VHTFPAVLQS<br>SGLYSLSSVV TVPSSSLGTQ TYICNVNHKP<br>SNTKVDKRVE PKSCDKTHTC PPCPAPEAEG<br>APSVFLFPPP KDTLMISRT PEVTCVVVDV<br>SHEDPEVKFN WYVDGVEVHN AKTKPREEQY<br>NSTYRVVSVL TVLHQDWLNG KEYKCKVSNK<br>ALPSSIEKTI SKAKGQPREP QVYTLPPSRE<br>EMTKNQVSLT CLVKGFYPSD IAVEWESNGQ<br>PENNYKTTPP VLDSDGSFFL YSKLTVDKSR<br>WQQGNVFSCS VMHEALHNHY TQKSLSLSPG |
| 206 | mAb-CD73.10-Vh-<br>hHC-IgG2-C219S | QVQLVESGGG VVQPGRSLRL SCAASGFTFS<br>NYGMHWVRQA PGKGLEWVAV IWYDESNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED<br>PEVQFNWYVD GVEVHNAKTK PREEQFNSTF<br>RVVSVLTVVH QDWLNGKEYK CKVSNKGLPA<br>PIEKTISKTK GQPREPQVYT LPPSREEMTK<br>NQVSLTCLVK GFYPSDIAVE WESNGQPENN<br>YKTTPPMLDS DGSFFLYSKL TVDKSRWQQG<br>NVFSCSVMHE ALHNHYTQKS LSLSPG |
| 207 | mAb-CD73.10-Vh-<br>hHC-IgG2-C219S-<br>IgG1.1f | QVQLVESGGG VVQPGRSLRL SCAASGFTFS<br>NYGMHWVRQA PGKGLEWVAV IWYDESNKYY<br>PDSVKGRFTI SRDNSKNTLY LQMNSLRAED<br>TAVYYCARGG SSWYPDSFDI WGQGTMVTVS<br>SASTKGPSVF PLAPCSRSTS ESTAALGCLV<br>KDYFPEPVTV SWNSGALTSG VHTFPAVLQS<br>SGLYSLSSVV TVPSSNFGTQ TYTCNVDHKP<br>SNTKVDKTVE RKSCVECPPC PAPPVAGPSV<br>FLFPPKPKDT LMISRTPEVT CVVVDVSHED |

| SEQ ID | Description | Sequence |
|---|---|---|
| | | PEVKFNWYVD GVEVHNAKTK PREEQYNSTY<br>RVVSVLTVLH QDWLNGKEYK CKVSNKALPS<br>SIEKTISKAK GQPREPQVYT LPPSREEMTK<br>NQVSLTCLVK GFYPSDIAVE WESNGQPENN<br>YKTTPPVLDS DGSFFLYSKL TVDKSRWQQG<br>NVFSCSVMHE ALHNHYTQKS LSLSPG |
| 208 | mAb-CD73.11-Vh-hHC-IgG1.1f | QVQLVESGGG VVQPGRSLRL SCAASGFTFS<br>NYGMHWVRQA PGKGLEWVAV IWYDESNKYY<br>ADSVKGRFTI SRDNSKNTLF LQMNSLRAED<br>TAVYYCARGY NSRWYPDAFD IWGQGTMVTV<br>SSASTKGPSV FPLAPSSKST SGGTAALGCL<br>VKDYFPEPVT VSWNSGALTS GVHTFPAVLQ<br>SSGLYSLSSV VTVPSSSLGT QTYICNVNHK<br>PSNTKVDKRV EPKSCDKTHT CPPCPAPEAE<br>GAPSVFLFPP KPKDTLMISR TPEVTCVVVD<br>VSHEDPEVKF NWYVDGVEVH NAKTKPREEQ<br>YNSTYRVVSV LTVLHQDWLN GKEYKCKVSN<br>KALPSSIEKT ISKAKGQPRE PQVYTLPPSR<br>EEMTKNQVSL TCLVKGFYPS DIAVEWESNG<br>QPENNYKTTP PVLDSDGSFF LYSKLTVDKS<br>RWQQGNVFSC SVMHEALHNH YTQKSLSLSPG |
| 209 | mAb-CD73.11-Vh-hHC-IgG2-C219S | QVQLVESGGG VVQPGRSLRL SCAASGFTFS<br>NYGMHWVRQA PGKGLEWVAV IWYDESNKYY<br>ADSVKGRFTI SRDNSKNTLF LQMNSLRAED<br>TAVYYCARGY NSRWYPDAFD IWGQGTMVTV<br>SSASTKGPSV FPLAPCSRST SESTAALGCL<br>VKDYFPEPVT VSWNSGALTS GVHTFPAVLQ<br>SSGLYSLSSV VTVPSSNFGT QTYTCNVDHK<br>PSNTKVDKTV ERKSCVECPP CPAPPVAGPS<br>VFLFPPKPKD TLMISRTPEV TCVVVDVSHE<br>DPEVQFNWYV DGVEVHNAKT KPREEQFNST<br>FRVVSVLTVV HQDWLNGKEY KCKVSNKGLP<br>APIEKTISKT KGQPREPQVY TLPPSREEMT<br>KNQVSLTCLV KGFYPSDIAV EWESNGQPEN<br>NYKTTPPMLD SDGSFFLYSK LTVDKSRWQQ<br>GNVFSCSVMH EALHNHYTQK SLSLSPG |
| 210 | mAb-CD73.11-Vh-hHC-IgG2-C219S-IgG1.1f | QVQLVESGGG VVQPGRSLRL SCAASGFTFS<br>NYGMHWVRQA PGKGLEWVAV IWYDESNKYY<br>ADSVKGRFTI SRDNSKNTLF LQMNSLRAED<br>TAVYYCARGY NSRWYPDAFD IWGQGTMVTV<br>SSASTKGPSV FPLAPCSRST SESTAALGCL<br>VKDYFPEPVT VSWNSGALTS GVHTFPAVLQ<br>SSGLYSLSSV VTVPSSNFGT QTYTCNVDHK<br>PSNTKVDKTV ERKSCVECPP CPAPPVAGPS<br>VFLFPPKPKD TLMISRTPEV TCVVVDVSHE<br>DPEVKFNWYV DGVEVHNAKT KPREEQYNST<br>YRVVSVLTVL HQDWLNGKEY KCKVSNKALP<br>SSIEKTISKA KGQPREPQVY TLPPSREEMT<br>KNQVSLTCLV KGFYPSDIAV EWESNGQPEN<br>NYKTTPPVLDSDGSFFLYSK LTVDKSRWQQ<br>GNVFSCSVMH EALHNHYTQK SLSLSPG |
| 211 | mAb-CD73.3-Vh-hHC-IgG1.1f | gaagtgcagctggtggagtctgggggaggcttggtacagcctggcaggtccct<br>gagactctcctgtgcagcctctggattcacctttgatgattatgccatg-<br>cactgggt<br>ccggcaagctccagggaagggcctggagtgggtctcaggtattagttggaaga<br>gtggtagcataggctatgcggactctgtgaagggccgattcaccatctccagag<br>acaacgccaagaactccctgtatctgcaaatgaacagtctgagagctgaggaca<br>cggccttgtattactgtgccaaagggtattacgttatttttgactggccttgac-<br>tactg<br>gggccagggaaccctggtcaccgtctcctcagcgtcgaccaagggcccctccg<br>tgtttcctctggcccttccagcaagtccacctctggcggaacagccgctctggg<br>ctgcctggtcaaggactacttccccgagcctgtgaccgtgtcctggaactctggc<br>gccctgacatctggcgtgcacaccttccctgctgtgctgcagtctagggcctgt<br>actccctgtcctccgtcgtgacagtgccctccagctctctgggcacccagaccta<br>catctgcaacgtgaaccacaagcccctcaacaccaaggtggacaagcgggtg<br>gaacccaagtcctgcgacaagacccatacctgccctccctgccctgctcctgaa<br>gctgaaggcgcccctagcgtgttcctgttccctccaaagcccaaggacaccctg<br>atgatctcccggacccctgaagtgacctgcgtggtggtggatgtgtcccacgag<br>gacccagaagtgaagttcaattggtacgtggacggcgtggaagtgcacaacgc<br>caagaccaagcctagagaggaacagtacaactccacctaccgggtggtgtccg<br>tgctgaccgtgctgcaccaggattggctgaacggcaaagagtacaagtgcaag<br>gtgtccaacaaggccctgcctagctccatcgaaaagaccatctccaaggctaag<br>ggccagccccgcgagccccaggtgtacacactgcctccatcccgggaagaga |

TABLE 35-continued

| SEQ ID | Description | Sequence |
|---|---|---|
| | | tgaccaagaaccaggtgtccctgacttgcctcgtgaagggcttctacccctccga tatcgccgtggaatgggagtccaacggccagcctgagaacaactacaagacca cccctcccgtgctggactccgacggctcattcttcctgtacagcaagctgacagt ggataagtcccggtggcagcaggggaacgtgttctcctgctccgtgatgcacga ggctctgcacaaccactacacacagaagtccctgtctctgtcccctggc |
| 212 | mAb-CD73.3-Vh-hHC-IgG2-C219S | gaagtgcagctggtggagtctgggggaggcttggtacagcctggcaggtccct gagactctcctgtgcagcctctggattcacctttgatgattatgccatg-cactgggt ccggcaagctccagggaagggcctggagtgggtctcaggtattagttggaaga gtggtagcataggctatgcggactctgtgaagggccgattcaccatctccagag acaacgccaagaactccctgtatctgcaaatgaacagtctgagagctgaggaca cggccttgtattactgtgccaaagggtattacgttatttttgactggccttgac-tactg gggccagggaaccctggtcaccgtctcctcagcgtcgaccaagggcccctctg tgtttcctctggcccttgctcccggtccacctctgagtctaccgct-gctctgggct gcctggtcaaggactacttccccgagcctgtgaccgtgtcctggaactctggcg ctctgacctccggcgtgcacacctttccagccgtgctgcagtcctccggcctgta ctctctgtcctccgtcgtgaccgtgccctcctccaacttcggcacccagacctaca cctgtaacgtggaccacaagccctccaacaccaaggtggacaagaccgtgaa cggaagtcctgcgtggaatgccctccttgccctgcacctcctgtggctggcccttt ccgtgttcctgttccccccaaagcccaaggacaccctgatgatctcccggaccc ccgaagtgacctgcgtggtggtggatgtgtcccacgaggaccccgaggtgcag ttcaattggtacgtggacggcgtggaagtgcacaacgccaagaccaagcccag agaggaacagttcaactccaccttccgggtggtgtccgtgctgaccgtggtgca ccaggactggctgaacggcaaagagtacaagtgcaaggtgtccaacaagggc ctgcctgcccccatcgaaaagaccatctccaagacaaagggccagccccgcg agcctcaggtgtacacactgcctccagccgggaagagatgaccaagaacca ggtgtccctgacctgtctggtcaagggcttctacccctccgatatcgccgtggaat gggagtccaacggccagcccgagaacaactacaagaccaccccccccatgct ggactccgacggctcattcttcctgtactccaagctgacagtggacaagtcccgg tggcagcagggcaacgtgttctcctgctctgtgatgcacgaggccctgcacaac cactacacccagaagtccctgtccctgagccccggcaa |
| 213 | mAb-CD73.3-Vh-hHC-IgG2-C219S-IgG1.1f | gaagtgcagctggtggagtctgggggaggcttggtacagcctggcaggtccct gagactctcctgtgcagcctctggattcacctttgatgattatgccatg-cactgggt ccggcaagctccagggaagggcctggagtgggtctcaggtattagttggaaga gtggtagcataggctatgcggactctgtgaagggccgattcaccatctccagag acaacgccaagaactccctgtatctgcaaatgaacagtctgagagctgaggaca cggccttgtattactgtgccaaagggtattacgttatttttgactggccttgac-tactg gggccagggaaccctggtcaccgtctcctcagcgtcgaccaagggcccatcg gtcttccccctggcgccctgctccaggagcacctccgagagcacagcggccct gggctgcctggtcaaggactacttccccgaaccggtgacggtgtcgtggaactc aggcgctctgaccagcggcgtgcacaccttcccagctgtcctacagtcctcagg actctactccctcagcagcgtggtgaccgtgccctccagcaacttcggcaccca gacctacacctgcaacgtagatcacaagcccagcaacaccaaggtggacaag acagttgagcgcaaatcctgtgtcgagtgcccaccgtgcccagcaccacctgtg gcaggaccgtcagtcttcctcttccccaaaacccaaggacaccctcatgatct cccggacccctgaggtcacatgcgtggtggtggacgtgagccacgaagaccct gaggtcaagttcaactggtacgtggacggcgtggaggtgcataatgccaagac aaagccgcgggaggagcagtacaacagcacgtaccgtgtggtcagcgtcctc accgtcctgcaccaggactggctgaatggcaaggagtacaagtgcaaggtctc caacaaagccctcccaagcagcatcgagaaaaccatctccaaagccaaaggg cagccccgagaaccacaggtgtacaccctgcccccatcccgggaggagatga ccaagaaccaggtcagcctgacctgcctggtcaaaggcttctatcccagcgaca tcgccgtggagtgggagagcaatgggcagccggagaacaactacaagaccac gcctcccgtgctggactccgacggctccttcttcctctatagcaagctcaccgtgg acaagagcaggtggcagcaggggaacgtcttctcatgctccgtgatgcatgag gctctgcacaaccactacacgcagaagagcctctccctgtccccgggtaaa |
| 214 | mAb-CD73.4-Vh-hHC-IgG1.1f | caggtgcagctggtggagtctgggggaggcgtggtccagcctggggaggtccc tgagactctcctgtgcagcctctggattcaccttcagtaactatggcatgcactgg gtccgccaggctccaggcaaggggctggagtgggtggcagttatattgtatgat ggaagtaataaatactatatcagactccgtgaagggccgattcaccatctccagag acaattccaagaacacgctgtatctgcaaatgaacagcctgagagccgaggac acggctgtgtattactgtgcgagaggggggcagcagctggtaccctgattcttttga tatctggggccaaggaacaatggtcaccgtctcttcagcgtcgaccaagggccc ctccgtgttcctctggcccttccagcaagtccacctctggcggaacagccgct ctgggctgcctggtcaaggactacttccccgagcctgtgaccgtgtcctggaact ctggcgcccctgacatctggcgtgcacaccttccctgctgtgctgcagtctagcgg cctgtactccctgtcctccgtcgtgacagtgccctccagctctctgggcacccag acctacatctgcaacgtgaaccacaagccctccaacaccaaggtggacaagcg ggtggaacccaagtcctgcgacaagacccatacctgccctccctgccctgctcc tgaagctgaaggcgccccctagcgtgttcctgttccctccaaagcccaaggacac |

TABLE 35-continued

| SEQ ID | Description | Sequence |
|---|---|---|
| | | cctgatgatctcccggacccctgaagtgacctgcgtggtggtggatgtgtcccac<br>gaggacccagaagtgaagttcaattggtacgtggacggcgtggaagtgcacaa<br>cgccaagaccaagcctagagaggaacagtacaactccacctaccgggtggtgt<br>ccgtgctgaccgtgctgcaccaggattggctgaacggcaaagagtacaagtgc<br>aaggtgtccaacaaggccctgcctagctccatcgaaaagaccatctccaaggct<br>aagggccagccccgcgagccccaggtgtacacactgcctccatcccgggaag<br>agatgaccaagaaccaggtgtccctgacttgcctcgtgaagggcttctacccctc<br>cgatatcgccgtggaatgggagtccaacggccagcctgagaacaactacaaga<br>ccacccctcccgtgctggactccgacggctcattcttcctgtacagcaagctgac<br>agtggataagtcccggtggcagcaggggaacgtgttctcctgctccgtgatgca<br>cgaggctctgcacaaccactacacacagaagtccctgtctctgtccctggc |
| 215 | mAb-CD73.4-Vh-hHC-IgG2-C219S | caggtgcagctggtggagtctgggggaggcgtggtccagcctggggaggtccc<br>tgagactctcctgtgcagcctctggattcaccttcagtaactatggcatgcactgg<br>gtccgccaggctccaggcaaggggctggagtgggtggcagttatattgtatgat<br>ggaagtaataaatactatccagactccgtgaagggccgattcaccatctccagag<br>acaattccaagaacacgctgtatctgcaaatgaacagcctgagagccgaggac<br>acggctgtgtattactgtgcgagaggggggcagcagctggtaccctgattcttttga<br>tatctggggccaaggaacaatggtcaccgtctcttcagcgtcgaccaagggccc<br>ctctgtgtttcctctggcccccttgctcccggtccacctctgagtctaccgct-<br>gctctg<br>ggctgcctggtcaaggactactccccgagcctgtgaccgtgtcctggaactctg<br>gcgctctgacctccggcgtgcacacctttccagccgtgctgcagtcctccggcct<br>gtactctctgtcctccgtcgtgaccgtgccctcctccaacttcggcacccugacct<br>acacctgtaacgtggaccacaagccctccaacaccaaggtggacaagaccgtg<br>gaacggaagtcctgcgtggaatgcccctcttgccctgcacctcctgtggctggc<br>ccttccgtgttcctgttccccccaaagcccaaggacaccctgatgatctcccgga<br>cccccgaagtgacctgcgtggtggtggatgtgtcccacgaggaccccgaggtg<br>cagttcaattggtacgtggacgcgtggaagtgcacaacgccaagaccaagcc<br>cagagaggaacagttcaactccaccttccgggtggtgtccgtgctgaccgtggt<br>gcaccaggactggctgaacggcaaagagtacaagtgcaaggtgtccaacaag<br>ggcctgcctgcccccatcgaaaagaccatctccaagacaaagggccagcccc<br>gcgagcctcaggtgtacacactgcctcccagccgggaagagatgaccaagaa<br>ccaggtgtccctgacctgtctggtcaagggcttctacccctccgatatcgccgtg<br>gaatgggagtccaacggccagcccgagaacaactacaagaccaccccccca<br>tgctggactccgacggctcattcttccctgtactccaagctgacagtgga-<br>caagtcc<br>cggtggcagcaggggcaacgtgttctcctgctctgtgatgcacgaggccctgcac<br>aaccactacacccagaagtccctgtccctgagccccggcaaa |
| 216 | mAb-CD73.4-Vh-hHC-IgG2-C219S-IgG1.1f | caggtgcagctggtggagtctgggggaggcgtggtccagcctggggaggtccc<br>tgagactctcctgtgcagcctctggattcaccttcagtaactatggcatgcactgg<br>gtccgccaggctccaggcaaggggctggagtgggtggcagttatattgtatgat<br>ggaagtaataaatactatccagactccgtgaagggccgattcaccatctccagag<br>acaattccaagaacacgctgtatctgcaaatgaacagcctgagagccgaggac<br>acggctgtgtattactgtgcgagaggggggcagcagctggtaccctgattcttttga<br>tatctggggccaaggaacaatggtcaccgtctcttcagcgtcgaccaagggccc<br>atcggtcttccccctggcgccctgctccaggagcacctccgagagcacagcgg<br>ccctgggctgcctggtcaaggactactccccgaaccggtgacggtgtcgtgga<br>actcaggcgctctgaccagcggcgtgcacacctttccagctgtcctacagtcctc<br>aggactctactccctcagcagcgtggtgaccgtgccctccagcaacttcggcac<br>ccagacctacacctgcaacgtagatcacaagcccagcaacaccaaggtggaca<br>agacagttgagcgcaaatcctgtgtcgagtgcccaccgtgcccagcaccacctg<br>tggcaggaccgtcagtcttcctcttccccccaaaacccaaggacaccctcatgat<br>ctcccggacccctgaggtcacatgcgtggtggtggacgtgagccacgaagacc<br>ctgaggtcaagttcaactggtacgtggacggcgtggaggtgcataatgccaaga<br>caaagccgcgggaggagcagtacaacagcacgtaccgtgtggtcagcgtcct<br>caccgtcctgcaccaggactggctgaatggcaaggagtacaagtgcaaggtct<br>ccaacaaagcccctcccaagcagcatcgagaaaaccatctccaaagccaaagg<br>gcagccccgagaaccacaggtgtacaccctgcccccatcccgggaggagatg<br>accaagaaccaggtcagcctgacctgcctggtcaaaggcttctatcccagcgac<br>atcgccgtggagtgggagagcaatgggcagccggagaacaactacaagacca<br>cgcctcccgtgctggactccgacggctccttcttcctctatagcaagctcaccgtg<br>gacaagagcaggtggcagcaggggaacgtcttctcatgctccgtgatgcatga<br>ggctctgcacaaccactacacgcagaagagcctctccctgtccccgggtaaa |
| 217 | mAb-CD73.5-Vh-hHC-IgG1.1f | caggtgcagctggtggagtctgggggaggcgtggtccagcctggggaggtccc<br>tgagactctcctgtgcaagctctggattcaccttcagtaactatggcatgcactgg<br>gtccgccaggctccaggcaaggggctggagtgggtggcagttatattgtatgat<br>ggaagtaataaatactatccagactccgtgaagggccgattcaccatctccagag<br>acaattccaagaacacgctgtatctgcaaatgaacagcctgagagccgaggac<br>acggctgtgtattactgtgcgagaggggggcagcagctggtaccctgattcttttga<br>tatctggggccaaggaacaatggtcaccgtctcttcagcgtcgaccaagggccc<br>ctctgtgtttcctctggcccccttccagcaagtccacctctggcggaacagccgct<br>ctgggctgcctggtcaaggactactccccgagcctgtgaccgtgtcctggaact<br>ctggcgccctgacatctggcgtgcacacctccctgctgtgctgcagtctagcgg<br>cctgtactccctgtcctccgtcgtgacagtgccctccagctctctgggcacccag |

TABLE 35-continued

| SEQ ID | Description | Sequence |
|---|---|---|
| | | acctacatctgcaacgtgaaccacaagccctccaacaccaaggtggacaagcg |
| | | ggtggaacccaagtcctgcgacaagacccatacctgccctcctgccctgctcc |
| | | tgaagctgaaggcgccccttagcgtgttcctgttccctccaaagcccaaggacac |
| | | cctgatgatctcccggacccctgaagtgacctgcgtggtggtggatgtgtcccac |
| | | gaggacccagaagtgaagttcaattggtacgtggacggcgtggaagtgcacaa |
| | | cgccaagaccaagcctagagaggaacagtacaactccacctaccgggtggtgt |
| | | ccgtgctgaccgtgctgcaccaggattggctgaacggcaaagagtacaagtgc |
| | | aaggtgtccaacaaggccctgcctagctccatcgaaaagaccatctccaaggct |
| | | aagggccagccccgcgagccccaggtgtacacactgcctccatcccgggaag |
| | | agatgaccaagaaccaggtgtccctgacttgcctcgtgaagggcttctacccctc |
| | | cgatatcgccgtggaatgggagtccaacggccagcctgagaacaactacaaga |
| | | ccacccctcccgtgctggactccgacggctcattcttcctgtacagcaagctgac |
| | | agtggataagtcccggtggcagcaggggaacgtgttctcctgctccgtgatgca |
| | | cgaggctctgcacaaccactacacacagaagtccctgtctctgtccctggc |
| 218 | mAb-CD73.5-Vh-hHC-IgG2-C219S | caggtgcagctggtggagtctggggggaggcgtggtccagcctggggaggtccc |
| | | tgagactctcctgtgcaagctctggattcaccttcagtaactatggcatgcactgg |
| | | gtccgccaggctccaggcaaggggctggagtgggtggcagttatattgtatgat |
| | | ggaagtaataaatactatccagactccgtgaagggccgattcaccatctccagag |
| | | acaattccaagaacacgctgtatctgcaaatgaacagcctgagagccgaggac |
| | | acggctgtgtattactgtgcgagagggggcagcagctggtaccctgattcttttga |
| | | tatctggggccaaggaacaatggtcaccgtctcttcagcgtcgaccaagggccc |
| | | ctctgtgttcctctcctggcccccttgctcccggtccacctctgagtctaccgct-gctctg |
| | | ggctgcctggtcaaggactacttccccgagcctgtgaccgtgtcctggaactctg |
| | | gcgctctgacctccggcgtgcacacctttccagccgtgctgcagtcctccggcct |
| | | gtactctctgtcctccgtcgtgaccgtgccctcctccaacttcggcacccagacct |
| | | acacctgtaacgtggaccacaagccctccaacaccaaggtggacaagaccgtg |
| | | gaacgaagtcctgcgtggaatgccctccttgccctgcacctcctgtggctggc |
| | | ccttccgtgttcctgttccccccaaagcccaaggacaccctgatgatctcccgga |
| | | cccccgaagtgacctgcgtggtggtggatgtgtcccacgaggaccccgaggtg |
| | | cagttcaattggtacgtggacggcgtggaagtgcacaacgccaagaccaagcc |
| | | cagagaggaacagttcaactccaccttccgggtggtgtccgtgctgaccgtggt |
| | | gcaccaggactggctgaacggcaaagagtacaagtgcaaggtgtccaacaag |
| | | ggcctgcctgcccccatcgaaaagaccatctccaagacaaagggccagcccc |
| | | gcgagcctcaggtgtacacactgcctcccagccgggaagagatgaccaagaa |
| | | ccaggtgtccctgacctgtctggtcaagggcttctacccctccgatatcgccgtg |
| | | gaatgggagtccaacggccagcctgagaacaactacaagaccacccccccca |
| | | tgctggactccgacggctcattcttcctgtactccaagctgacagtggacaagtcc |
| | | cggtggcagcagggcaacgtgttctcctgctctgtgatgcacgaggccctgcac |
| | | aaccactacacccagaagtccctgtccctgagccccggcaaa |
| 219 | mAb-CD73.5-Vh-hHC-IgG2-C219S-IgG1.1f | caggtgcagctggtggagtctgggggaggcgtggtccagcctggggaggtccc |
| | | tgagactctcctgtgcaagctctggattcaccttcagtaactatggcatgcactgg |
| | | gtccgccaggctccaggcaaggggctggagtgggtggcagttatattgtatgat |
| | | ggaagtaataaatactatccagactccgtgaagggccgattcaccatctccagag |
| | | acaattccaagaacacgctgtatctgcaaatgaacagcctgagagccgaggac |
| | | acggctgtgtattactgtgcgagagggggcagcagctggtaccctgattcttttga |
| | | tatctggggccaaggaacaatggtcaccgtctcttcagcgtcgaccaagggccc |
| | | atcggtcttcccctggcgccctgctccaggagcacctccgagagcacagcgg |
| | | ccctgggctgcctggtcaaggactacttccccgaacctgtgacggtgtcgtgga |
| | | actcaggcgctctgaccagcggcgtgcacaccttcccagctgtcctacagtcctc |
| | | aggactctactccctcagcagcgtggtgaccgtgccctccagcaacttcggcac |
| | | ccagacctacacctgcaacgtagatcacaagcccagcaacaccaaggtggaca |
| | | agacagttgagcgcaaatcctgtgtcgagtgcccacctgtgccagcaccacctg |
| | | tggcaggaccgtcagtcttcctcttccccccaaaacccaaggacaccctcatgat |
| | | ctcccggacccctgaggtcacatgcgtggtggtggacgtgagccacgaagacc |
| | | ctgaggtcaagttcaactggtacgtggacggcgtggaggtgcataatgccaaga |
| | | caaagccgcgggaggagcagtacaacagcacgtaccgtgtggtcagcgtcct |
| | | caccgtcctgcaccaggactggctgaatggcaaggagtacaagtgcaaggtct |
| | | ccaacaaagcctcccagcagcatcgagaaaaccatctccaaagccaaagg |
| | | gcagccccgagaaccacaggtgtacaccctgccccatcccgggaggagatg |
| | | accaagaaccaggtcagcctgacctgcctggtcaaaggcttctatcccagcgac |
| | | atcgccgtggagtgggagagcaatgggcagccggagaacaactacaagacca |
| | | cgcctcccgtgctggactccgacggctccttcttcctctatagcaagctcaccgtg |
| | | gacaagagcaggtggcagcaggggaacgtcttctcatgctccgtgatgcatga |
| | | ggctctgcacaaccactacacgcagaagagcctctccctgtccccgggtaaa |
| 220 | mAb-CD73.6-Vh-hHC-IgG1.1f | ggcatgcactgggtccgccaggctccaggcaagggctggagtgggtggcag |
| | | ttatattgtatgattccagtaataaatactatccagactccgtgaagggccgat-tca |
| | | ccatctccagagacaattccaagaacacgctgtatctgcaaatgaacagcctga |
| | | gagccgaggacacggctgtgtattactgtgcgagagggggcagcagctggtac |
| | | cctgattcttttgatatctggggccaaggaacaatggtcaccgtctcttca-gcgtcg |
| | | accaagggcccctccgtgtttcctctggcccccttccagcaagtccacctctggcg |
| | | gaacagccgctctgggctgcctggtcaaggactacttccccgagcctgtgaccg |

TABLE 35-continued

| SEQ ID | Description | Sequence |
|---|---|---|
| | | tgtcctggaactctggcgccctgacatctggcgtgcacaccttccctgctgtgctg cagtctagcggcctgtactccctgtcctccgtcgtgacagtgccctccagctctct gggcacccagacctacatctgcaacgtgaaccacaagccctccaacaccaagg tggacaagcgggtggaacccaagtcctgcgacaagacccatacctgccctccc tgccctgctcctgaagctgaaggcgccctagcgtgttcctgttccctccaaagc ccaaggacaccctgatgatctcccggacccctgaagtgacctgcgtggtggtgg atgtgtcccacgaggacccagaagtgaagttcaattggtacgtggacggcgtgg aagtgcacaacgccaagaccaagcctagagaggaacagtacaactccacctac cgggtggtgtccgtgctgaccgtgctgcaccaggattggctgaacggcaaaga gtacaagtgcaaggtgtccaacaagcccgcctagctccatcgaaaagaccat ctccaaggctaagggccagccccgcgagccccaggtgtacacactgcctccat cccgggaagagatgaccaagaaccaggtgtccctgacttgcctcgtgaagggc ttctaccctccgatatcgccgtggaatgggagtccaacggccagcctgagaac aactacaagaccacccctcccgtgctggactccgacggctcattcttcctgtaca gcaagctgacagtggataagtcccggtggcagcaggggaacgtgttctcctgct ccgtgatgcacgaggctctgcacaaccactacacacagaagtccctgtctctgtc ccctggc |
| 221 | mAb-CD73.6-Vh-hHC-IgG2-C219S | caggtgcagctggtggagtctggggaggcgtggtccagcctggggaggtccct gagactctcctgtgcagcctctggattcaccttcagtaactatggcatgcactggg tccgccaggctccaggcaaggggctggagtgggtggcagttatattgtatgattc cagtaataaatactatccagactccgtgaagggccgattcaccatctccagagac aattccaagaacacgctgtatctgcaaatgaacagcctgagagccgaggacac ggctgtgtattactgtgcgagagggggcagcagctggtaccctgattctttgata tctggggccaaggaacaatggtcaccgtctcttcagcgtcgaccaagggcccct ctgtgtttcctctggcccctgctcccggtccacctctgagtctaccgct- gctctgg gctgcctggtcaaggactacttccccgagcctgtgaccgtgtcctggaactctgg cgctctgacctccggcgtgcacacctttccagccgtgctgcagtcctccggcctg tactctctgtcctccgtcgtgaccgtgccctcctccaacttcggcacccagaccta cacctgtaacgtggaccacaagccctccaacaccaaggtggacaagaccgtgg aacggaagtcctgcgtggaatgccctcttgccctgcacctcctgtggctggccc ttccgtgttcctgttccccccaaagcccaaggacaccctgatgatctcccggacc cccgaagtgacctgcgtggtggtggatgtgtcccacgaggaccccgaggtgca gttcaattggtacgtggacggcgtggaagtgcacaacgccaagaccaagccca gagaggaacagttcaactccaccttccgggtggtgtccgtgctgaccgtggtgc accaggactggctgaacggcaaagagtacaagtgcaaggtgtccaacaaggg cctgcctgcccccatcgaaaagaccatctccaagacaaagggccagccccgc gagcctcaggtgtacacactgcctcccagccgggaagagatgaccaagaacc aggtgtccctgacctgtctggtcaagggcttctaccctccgatatcgccgtgga atgggagtccaacggccagcccgagaacaactacaagaccaccccccccatg ctggactccgacggctcattcttcctgtactccaagctgacagtggacaagtccc ggtggcagcagggcaacgtgttctcctgctctgtgatgcacgaggccctgcaca accactacacccagaagtccctgtccctgagccccggcaaa |
| 222 | mAb-CD73.6-Vh-hHC-IgG2-C219S-IgG1.1f | caggtgcagctggtggagtctggggaggcgtggtccagcctggggaggtccct gagactctcctgtgcagcctctggattcaccttcagtaactatggcatgcactggg tccgccaggctccaggcaaggggctggagtgggtggcagttatattgtatgattc cagtaataaatactatccagactccgtgaagggccgattcaccatctccagagac aattccaagaacacgctgtatctgcaaatgaacagcctgagagccgaggacac ggctgtgtattactgtgcgagagggggcagcagctggtaccctgattctttgata tctggggccaaggaacaatggtcaccgtctcttcagcgtcgaccaagggcccat cggtcttccccctggcgccctgctccaggagcacctccgagagcacagcggcc ctgggctgcctggtcaaggactacttccccgaaccggtgacggtgtcgtggaac tcaggcgctctgaccagcggcgtgcacaccttcccagctgtcctacagtcctca ggactctactccctcagcagcgtggtgaccgtgccctccagcaacttcggcacc cagacctacacctgcaacgtagatcacaagcccagcaacaccaaggtggacaa gacagttgagcgcaaatcctgtgtcgagtgcccaccgtgcccagcaccacctgt ggcaggaccgtcagtcttcctcttccccccaaaacccaaggacaccctcatgatc tcccggacccctgaggtcacatgcgtggtggtggacgtgagccacgaagaccc tgaggtcaagttcaactggtacgtggacggcgtggaggtgcataatgccaagac aaagccgcgggaggagcagtacaacagcacgtaccgtgtggtcagcgtcctc accgtcctgcaccaggactggctgaatggcaaggagtacaagtgcaaggtctc caacaaagccctcccagcagcatcgagaaaaccatctccaaagccaaaggg cagccccgagaaccacaggtgtacaccctgcccccatcccgggaggagatga ccaagaaccaggtcagcctgacctgcctggtcaaaggcttctatcccagcgaca tcgccgtggagtgggagagcaatgggcagccggagaacaactacaagaccac gcctcccgtgctggactccgacggctccttcttcctctatagcaagctcaccgtgg acaagagcaggtggcagcaggggaacgtcttctcatgctccgtgatgcatgag gctctgcacaaccactacacgcagaagagcctctccctgtccccgggtaaa |
| 223 | mAb-CD73.7-Vh-hHC-IgG1.1f | caggtgcagctggtggagtctggggaggcgtggtccagcctggggaggtccct gagactctcctgtgcaagctctggattcaccttcagtaactatggcatgcactggg tccgccaggctccaggcaaggggctggagtgggtggcagttatattgtatgattc cagtaataaatactatccagactccgtgaagggccgattcaccatctccagagac aattccaagaacacgctgtatctgcaaatgaacagcctgagagccgaggacac ggctgtgtattactgtgcgagagggggcagcagctggtaccctgattctttgata |

TABLE 35-continued

| SEQ ID | Description | Sequence |
|---|---|---|
| | | tctggggccaaggaacaatggtcaccgtctcttcagcgtcgaccaagggcccct |
| | | ccgtgtttcctctggccccttccagcaagtccacctctggcggaacagccgctct |
| | | gggctgcctggtcaaggactactccccgagcctgtgaccgtgtcctggaactct |
| | | ggcgccctgacatctggcgtgcacaccttcctgctgtgctgcagtctagcggc |
| | | ctgtactccctgtcctccgtcgtgacagtgcctccagctctctgggcacccaga |
| | | cctacatctgcaacgtgaaccacaagccctccaacaccaaggtggacaagcgg |
| | | gtggaacccaagtcctgcgacaagacccatacctgccctcctgccctgctcct |
| | | gaagctgaaggcgccctagcgtgttcctgttccctccaaagcccaaggacacc |
| | | ctgatgatctcccggacccctgaagtgacctgcgtggtggtggatgtgtcccacg |
| | | aggacccagaagtgaagttcaattggtacgtggacggcgtggaagtgcacaac |
| | | gccaagaccaagcctagagaggaacagtacaactccacctactgggtggtgtc |
| | | cgtgctgaccgtgctgcaccaggattggctgaacggcaaagagtacaagtgca |
| | | aggtgtccaacaaggccctgcctagctccatcgaaaagaccatctccaaggcta |
| | | agggccagccccgcgagcccaggtgtacacactgcctccatcccgggaaga |
| | | gatgaccaagaaccaggtgtccctgacttgcctcgtgaagggcttctacccctcc |
| | | gatatcgccgtggaatgggagtccaacggccagcctgagaacaactacaagac |
| | | cacccaccccgtgctggactccgacggctcattcttcctgtacagcaagctgaca |
| | | gtggataagtcccggtggcagcaggggaacgtgttcctcctgctccgtgatgcac |
| | | gaggctctgcacaaccactacacacagaagtccctgtctctgtccctggc |
| 224 | mAb-CD73.7-Vh-<br>hHC-IgG2-C219S | caggtgcagctggtggagtctggggggaggcgtggtccagcctggggaggtccct<br>gagactctcctgtgcaagctctggattcaccttcagtaactatggcatgcactggg<br>tccgccaggctccaggcaaggggctggagtgggtggcagttatattgtatgattc<br>cagtaataaatactatccagactccgtgaagggccgattcaccatctccagagac<br>aattccaagaacacgctgtatctgcaaatgaacagcctgagagccgaggacac<br>ggctgtgtattactgtgcgagaggggggcagcagctggtaccctgattcttttgata<br>tctggggccaaggaacaatggtcaccgtctcttcagcgtcgaccaagggcccct<br>ctgtgtttcctctggcccccttgctcccggtccacctctgagtctaccgct-<br>gctctgg<br>gctgcctggtcaaggactactccccgagcctgtgaccgtgtcctggaactctgg<br>cgctctgacctccgcgtgcacaccttccagccgtgctgcagtcctccggcctg<br>tactctctgtcctccgtcgtgaccgtgccctcctccaacttcggcacccagaccta<br>cacctgtaacgtggaccacaagcccccaacaccaaggtggacaagaccgtgg<br>aacggaagtcctgcgtggaatgccctccttgccctgcacctcctgtggctggccc<br>ttccgtgttcctgttccccccaaagcccaaggacaccctgatgatctcccggacc<br>cccgaagtgacctgcgtggtggtggatgtgtcccacgaggaccccgaggtgca<br>gttcaattggtacgtggacggcgtggaagtgcacaacgccaagaccaagccca<br>gagaggaacagttcaactccaccttccgggtggtgtccgtgctgaccgtggtgc<br>accaggactggctgaacggcaaagagtacaagtgcaaggtgtccaacaaggg<br>cctgcctgccccccatcgaaaagaccatctccaagacaaagggccagccccgc<br>gagcctcaggtgtacacactgcctcccagccgggaagagatgaccaagaacc<br>aggtgtccctgacctgtctggtcaagggcttctaccccctccgatatcgccgtgga<br>atgggagtccaacggccagcccgagaacaactacaagacccaccccccccatg<br>ctggactccgacggctcattcttcctgtactccaagctgacagtggacaagtccc<br>ggtggcagcagggcaacgtgttcctcctgctctgtgatgcacgaggccctgcaca<br>accactacacccacaagtccctgtccctgagccccccgcaaa |
| 225 | mAb-CD73.7-Vh-<br>hHC-IgG2-C219S-<br>IgG1.1f | caggtgcagctggtggagtctggggggaggcgtggtccagcctggggaggtccct<br>gagactctcctgtgcaagctctggattcaccttcagtaactatggcatgcactggg<br>tccgccaggctccaggcaaggggctggagtgggtggcagttatattgtatgattc<br>cagtaataaatactatccagactccgtgaagggccgattcaccatctccagagac<br>aattccaagaacacgctgtatctgcaaatgaacagcctgagagccgaggacac<br>ggctgtgtattactgtgcgagaggggggcagcagctggtaccctgattcttttgata<br>tctggggccaaggaacaatggtcaccgtctcttcagcgtcgaccaagggcccat<br>cggtcttcccccctggcgccctgctccaggagcacctccgagagcacagcggcc<br>ctgggctgcctggtcaaggactactccccgaaccggtgacggtgtcgtggaac<br>tcaggcgctctgaccagcggcgtgcacaccttcccagctgtcctacagtcctca<br>ggactctactccctcagcagcgtggtgaccgtgccctccagcaacttcggcacc<br>cagacctacacctgcaacgtagatcacaagcccagcaacaccaaggtggacaa<br>gacagttgagcgcaaatcctgtgtcgagtgcccaccgtgcccagcaccacctgt<br>ggcaggaccgtcagtcttcctcttccccccaaaacccaaggacaccctcatgatc<br>tcccggacccctgaggtcacatgcgtggtggtggacgtgagccacgaagaccc<br>tgaggtcaagttcaactggtacgtggacggcgtggaggtgcataatgccaagac<br>aaagccgcggggaggagcagtacaacagcacgtaccgtgtggtcagcgtcctc<br>accgtcctgcaccaggactggctgaatggcaaggagtacaagtgcaaggtctc<br>caacaaagccctcccaagcagcatcgagaaaaccatctccaaagccaaaggg<br>cagccccgagaaccacaggtgtacaccctgcccccatcccgggaggagatga<br>ccaagaaccaggtcagcctgacctgcctggtcaaaggcttctatcccagcgaca<br>tcgccgtggagtgggagagcaatgggcagccggagaacaactacaagaccac<br>gcctcccgtgctggactccgacggctccttcttcctctatagcaagctcaccgtgg<br>acaagagcaggtggcagcaggggaacgtcttctcatgctccgtgatgcatgag<br>gctctgcacaaccactacacgcagaagagcctctccctgtcccgggtaaa |
| 226 | mAb-CD73.8-Vh-<br>hHC-IgG1.1f | caggtgcagctggtggagtctggggggaggcgtggtccagcctggggaggtccct<br>gagactctcctgtgcagcctctggattcaccttcagtaactatggcatgcactggg<br>tccgccaggctccaggcaaggggctggagtgggtggcagttatatggtatgatt<br>ccagtaataaatactatccagactccgtgaagggccgattcaccatctccagaga |

TABLE 35-continued

| SEQ ID | Description | Sequence |
|---|---|---|
| | | caattccaagaacacgctgtatctgcaaatgaacagcctgagagccgaggaca cggctgtgtattactgtgcgagaggggcagcagctggtaccctgattcttttgat atctggggccaaggaacaatggtcaccgtctcttcagcgtcgaccaagggccc ctccgtgtttcctctggcccttccagcaagtccacctctggcggaacagccgct ctgggctgcctggtcaaggaccacttccccgagcctgtgaccgtgtcctggaact ctggcgccctgacatctggcgigcacaccttcctgctgtgctgcagtctagcgg cctgtactccctgtcctccgtcgtgacagtgccctccagctctctgggcacccag acctacatctgcaacgtgaaccacaagcctccaacaccaaggtggacaagcg ggtggaacccaagtcctgcgacaagacccatacctgccctccctgccctgctcc tgaagctgaaggcgcccctagcgtgttcctgttccctccaaagcccaaggacac cctgatgatctcccggacccctgaagtgacctgcgtggtggtggatgtgtcccac gaggacccagaagtgaagttcaattggtacgtggacggcgtggaagtgcacaa cgccaagaccaagcctagagaggaacagtacaactccacctaccgggtggtct ccgtgctgaccgtgctgcaccaggattggctgaacggcaaagagtacaagtgc aaggtgtccaacaaggccctgcctagctccatcgaaaagaccatctccaaggct aagggccagccccgcgagccccaggtgtacacactgcctccatcccgggaag agatgaccaagaaccaggtgtccctgacttgcctcgtgaagggcttctacccctc cgatatcgccgtggaatgggagtccaacggccagcctgagaacaactacaaga ccacccctcccgtgctggactccgacggctcattcttcctgtacagcaagctgac agtggataagtcccggtggcagcaggggaacgtgttctcctgctccgtgatgca cgaggctctgcacaaccactacacacgaagtcccgtctctgtccctggc |
| 227 | mAb-CD73.8-Vh-hHC-IgG2-C219S | caggtgcagctggtggagtctgggggaggcgtggtccagcctggggaggtccct gagactctcctgtgcagcctctggattcaccttcagtaactatggcatgcactggg tccgccaggctccaggcaaggggctggagtgggtggcagttatatggtatgatt ccagtaataaatactatccagactccgtgaagggccgattcaccatctccagaga caattccaagaacacgctgtatctgcaaatgaacagcctgagagccgaggaca cggctgtgtattactgtgcgagaggggcagcagctggtaccctgattcttttgat atctggggccaaggaacaatggtcaccgtctcttcagcgtcgaccaagggccc ctctgtgtttcctctggcccctgctcccggtccacctctgagtctaccgct-gctctg ggctgcctggtcaaggactactttccccgagcctgtgaccgtgtcctggaactctg gcgctctgacctccggcgtgcacaccttttccagccgtgctgcagtcctccggcct gtactctctgtcctccgtcgtgaccgtgccctcctccaacttcggcacccagacct acacctgtaacgtggaccacaagcctccaacaccaaggtggacaagaccgtg aacggaagtcctgcgtggaatgccctcttgccctgcacctcctgtggctggc ccttccgtgttcctgttccccaaagcccaaggacacccctgatgatctcccgga ccccgaagtgacctgcgtggtggtggatgtgtcccacgaggaccccgaggtg cagttcaattggtacgtggacggcgtggaagtgcacaacgccaagaccaagcc cagagaggaacagttcaactccaccttccgggtggtgtccgtgctgaccgtggt gcaccaggactggctgaacggcaaagagtacaagtgcaaggtgtccaacaag ggcctgcctgccccatcgaaaagaccatctccaagacaaagggccagcccc gcgagcctcaggtgtacacactgcctcccagccgggaagagatgactaagaa ccaggtgtccctgacctgtctggtcaagggcttctacccctccgatatcgccgtg gaatgggagtccaacggccagcccgagaacaactacaagaccaccccccca tgctggactccgacggctcattcttcctgtactccaagctgacagtggacaagtcc cggtggcagcagggcaacgtgttctcctgctctgtgatgcacgaggccctgcac aaccactacacccagaagtccctgtccctgagccccggcaaa |
| 228 | mAb-CD73.8-Vh-hHC-IgG2-C219S-IgG1.1f | caggtgcagctggtggagtctgggggaggcgtggtccagcctggggaggtccct gagactctcctgtgcagcctctggattcaccttcagtaactatggcatgcactggg tccgccaggctccaggcaaggggctggagtgggtggcagttatatggtatgatt ccagtaataaatactatccagactccgtrgaagggccgattcaccatctccagaga caattccaagaacacgctgtatctgcaaatgaacagcctgagagccgaggaca cggctgtgtattactgtgcgagaggggcagcagctggtaecctgattcttttgat atctggggccaaggaacaatggtcaccgtctcttcagcgtcgaccaagggccc atcggtcttccccctggcgccctgctccaggagcacctccgagagcacagcgg ccctgggctgcctggtcaaggactacttccccgaaccggtgacggtgtcgtgga actcaggcgctctgaccagcggcgtgcacaccttcccagctgtcctacagtcctc aggactctactccctcagcagcgtggtgaccgtgccctccagcaacttcggcac ccagacctacacctgcaacgtagatcacaagcccagcaacaccaaggtggaca agacagttgagcgcaaatcctgtgtcgagtgcccaccgtgcccagcaccacctg tggcaggaccgtcagtcttcctcttccccccaaaacccaaggacaccctcatgat ctcccggacccctgaggtcacatgcgtggtggtggacgtgagccacgaagacc ctgaggtcaagttcaactggtacgtggacggcgtggaggtgcataatgccaaga caaagccgcgggaggagcagtacaacagcacgtaccgtgtggtcagcgtcct caccgtcctgcaccaggactggctgaatggcaaggagtacaagtgcaaggtct ccaacaaagcccctcccagcagcgtggagaaaaccatctccaaagccaaagg gcagccccgagaaccacaggtgtacaccctgcccccatcccgggaggagatg accaagaaccaggtcagcctgacctgcctggtcaaaggcttctatcccagcgac atcgccgtggagtgggagagcaatgggcagccggagaacaactacaagacca cgcctcccgtgctggactccgacggctccttcttcctctatgcaagctcaccgtg gacaagagcaggtggcagcaggggaacgtcttctcatgctccgtgatgcatga ggctctgcacaaccactacacgcagaagagcctctccctgtccccgggtaaa |

TABLE 35-continued

| SEQ ID Description | Sequence |
|---|---|
| 229 mAb-CD73.9-Vh-hHC.IgG1.1f | caggtgcagctggtggagtctgggggaggcgtggtccagcctggggaggtccct gagactctcctgtgcaagctctggattcaccttcagtaactatggcatgcactggg tccgccaggctccaggcaaggggctggagtgggtggcagttatatggtatgatt ccagtaataaatactatccagactccgtgaagggccgattcaccatctccagaga caattccaagaacacgtgtatctgcaaatgaacagcctgagagccgaggaca cggctgtgtattactgtgcgagaggggggcagcagctggtaccctgattcttttgat atctggggccaaggaacaatggtcaccgtctcttcagcgtcgaccaagggccc ctccgtgtttcctctggcccccttccagcaagtccacctctggcggaacagccgct ctgggctgcctggtcaaggactacttccccgagcctgtgaccgtgtcctggaact ctggcgcccctgacatctggcgtgcacaccttccctgctgtgctgcagtctagcgg cctgtactccctgtcctccgtcgtgacagtgccctccagctctctgggcacccag acctacatctgcaacgtgaaccacaagccctccaacaccaaggtggacaagcg ggtggaacccaagtcctgcgacaagacccatacctgccctccctgccctgctcc tgaagctgaaggcgcccctagcgtgttcctgttccctccaaagcccaaggacac cctgatgatctcccggacccctgaagtgacctgcgtggtggtggatgtgtcccac gaggacccagaagtgaagttcaattggtacgtggacggcgtggaagtgcacaa cgccaagaccaagcctagagaggaacagtacaactccacctaccgggcggtgt ccgtgctgaccgtgctgcaccaggattggctgaacggcaaagagtacaagtgc aaggtgtccaacaagggccctgcctagctccatcgaaaagaccatctccaaggct aagggccagccccgcgagccccaggtgtacacactgcctccatcccgggaag agatgaccaagaaccaggtgtccctgacttgcctcgtgaagggcttctacccctc cgatatcgccgtggaatgggagtccaacggccagcctgagaacaactacaaga ccaccCctcccgtgctggactccgacggctcattcttcctgtacagcaagctgac agtggataagtcccggtggcagcaggggaacgtgttctcctgctccgtgatgca cgaggctctgcacaaccactacacacagaagtccctgtctctgtcccctggc |
| 230 mAb-CD73.9-Vh-hHC-IgG2-C219S | caggtgcagctggtggagtctgggggaggcgtggtccagcctggggaggtccct gagactctcctgtgcaagctctggattcaccttcagtaactatggcatgcactggg tccgccaggctccaggcaaggggctggagtgggtggcagttatatggtatgatt ccagtaataaatactatccagactccgtgaagggccgattcaccatctccagaga caattccaagaacacgctgtatctgcaaatgaacagcctgagagccgaggaca cggctgtgtattactgtgcgagaggggggcagcagctggtaccctgattcttttgat atctggggccaaggaacaatggtcaccgtctcttcagcgtcgaccaagggccc ctctgtgtttcctctggccccttgctccgggtccacctctgagtctaccgct-gctctg ggctgcctggtcaaggactacttccccgagcctgtgaccgtgtcctggaactctg gcgctctgacctccggcgtgcacaccttttccagccgtgctgcagtcctccggcct gtactctctgtcctccgtcgtgaccgtgccctcctcaacttcggcacccagacct acacctgtaacgtggaccacaagccctccaacaccaaggtggacaagaccgtg gaacggaagtcctgcgtggaatgccctccttgccctgcacctcctgtggctggc ccttccgtgttcctgctccccccaaagcccaaggacacccctgatgatctcccgga cccccgaagtgacctgcgtggtggtggatgtgtcccacgaggacccccgaggcg cagttcaattggtacgtggacggcgtggaagtgcacaacgccaagaccaagcc cagagaggaacagttcaactccaccttccgggtggtgtccgtgctgaccgtggt gcaccaggactggctgaacggcaaagagtacaagtgcaaggtgtccaacaag ggcctgcctgcccccatcgaaaagaccatctccaagacaaagggccagcccc gcgagcctcaggtgtacacactgcctcccagccgggaagagatgaccaagaa ccaggtgtccctgacctgtctggtcaagggcttctacccctccgatatcgccgtg gaatgggagtccaacggccagcccgagaacaactacaagaccacccccccca tgctggactccgacggctcattcttcctgtactccaagctgacagtggacaagtcc cggtggcagcagggcaacgtgttctcctgctctgtgatgcacgaggccctgcac aaccactacacccagaagtccctgtccctgagcccccggcaaa |
| 231 mAb-CD73.9-Vh-hHC-IgG2-C219S-IgG1.1f | caggtgcagctggtggagtctgggggaggcgtggtccagcctggggaggtccct gagactctcctgtgcaagctctggattcaccttcagtaactatggcatgcactggg tccgccaggctccaggcaaggggctggagtgggtggcagttatatggtatgatt ccagtaataaatactatccagactccgtgaagggccgattcaccatctccagaga caattccaagaacacgctgtatctgcaaatgaacagcctgagagccgaggaca cggctgtgtattactgtgcgagaggggggcagcagctggtaccctgattcttttgat atctggggccaaggaacaatggtcaccgtctcttcagcgtcgaccaagggccc atcggtcttcccctggcgccctgctccaggagcacctccgagagcacagcgg ccctgggctgcctggtcaaggactacttccccgaaccggtgacggtgtcgtgga actcaggcgcgctgaccagcggcgtgcacaccttcccagctgtcctacagtcctc aggactctactccctcagcagcgtggtgaccgtgccctccagcaacttcggcac ccagacctacacctgcaacgtagatcacaagcccagcaacaccaaggtggaca gacagttgagcgcaaatcctgtgtcgagtgcccaccgtgcccagcaccacctg tggcaggaccgtcagtcttcctcttccccccaaaacccaaggacaccctcatgat ctcccggacccctgaggtcacatgcgtggtggtggacgtgagccacgaagacc ctgaggtcaagttcaactggtacgtggacggcgtggaggtgcataatgccaaga caaagccgcgggaggagcagtacaacagcacgtaccgtgtggtcagcgtcct caccgtcctgcaccaggactggctgaatggcaaggagtacaagtgcaaggtct ccaacaaagccctcccaagcagcatcgagaaaaccatctccaaagccaaagg gcagccccgagaaccacaggtgtacaccctgccccatcccgggaggagatg accaagaaccaggtcagcctgacctgcctggtcaaaggcttctatcccagcgac atcgccgtggagtgggagagcaatgggcagccggagaacaactacaagacca cgcctcccgtgctggactccgacggctccttcttcctctatagcaagctcaccgtg |

TABLE 35-continued

| SEQ ID | Description | Sequence |
|---|---|---|
| | | gacaagagcaggtggcagcaggggaacgtcttctcatgctccgtgatgcatga<br>ggctctgcacaaccactacacgcagaagagcctctccctgtccccgggtaaa |
| 232 | mAb-CD73.10-Vh-<br>hHC-IgG1.1f | caggtgcagctggtggagtctgggggaggcgtggtccagcctggggaggtccct<br>gagactctcctgtgcagcctctggattcaccttcagtaactatggcatgcactggg<br>tccgccaggctccaggcaaggggctggagtgggtggcagttatatggtatgatg<br>agagtaataaatactatccagactccgtgaagggccgattcaccatctccagaga<br>caattccaagaacacgctgtatctgcaaatgaacagcctgagagccgaggaca<br>cggctgtgtattactgtgcgagaggggggcagcagctggtaccctgattcttttgat<br>atctggggccaaggaacaatggtcaccgtctcttcagcgtcgaccaagggccc<br>ctccgtgtttcctctggccccttccagcaagtccacctctggcggaacagccgct<br>ctgggctgcctggtcaaggactactccccgagcctgtgaccgtgtcctggaact<br>ctggcgccctgacatctggcgtgcacaccttccctgctgtgctgcagtctagcgg<br>cctgtactccctgtcctccgtcgtgacagcgccctccagctctctgggcacccag<br>acctacatctgcaacgtgaaccacaagccctccaacaccaaggtggacaagcg<br>ggtggaacccaagtcctgcgacaagacccatacctgccctccctgccctgctcc<br>tgaagctgaaggcgccctagcgtgttcctgttccctccaaagcccaaggacac<br>cctgatgatctcccggacccctgaagtgacctgcgtggtggtggatgtgtcccac<br>gaggaccctgaagtgaagttcaattggtacgtggacggcgtggaagtgcacaa<br>cgccaagaccaagcctagagaggaacagtacaactccacctaccgggtggtgt<br>ccgtgctgaccgtgctgcaccaggattggctgaacggcaaagagtacaagtgc<br>aaggtgtccaacaaggccctgcctagctccatcgaaaagaccatctccaaggct<br>aagggccagccccgcgagccccaggtgtacacactgcctccatcccgggaag<br>agatgaccaagaaccaggtgtccctgacttgcctcgtgaagggcttctacccctc<br>cgatatcgccgtggaatgggagtccaacggccagcctgagaacaactacaaga<br>ccacccctcccgtgctggactccgacggctcattcttcctgtacagcaagctgac<br>agtggataagtcccggtggcagcaggggaacgtgttctcctgctccgtgatgca<br>cgaggctctgcacaaccactacacacagaagtccctgtctctgtccctggc |
| 233 | mAb-CD73.10-Vh-<br>hHC-IgG2-C219S | caggtgcagctggtggagtctgggggaggcgtggtccagcctggggaggtccct<br>gagactctcctgtgcagcctctggattcaccttcagtaactatggcatgcactggg<br>tccgccaggctccaggcaaggggctggagtgggtggcagttatatggtatgatg<br>agagtaataaatactatccagactccgtgaagggccgattcaccatctccagaga<br>caattccaagaacacgctgtatctgcaaatgaacagcctgagagccgaggaca<br>cggctgtgtattactgtgcgagaggggggcagcagctggtaccctgattcttttgat<br>atctggggccaaggaacaatggtcaccgtctcttcagcgtcgaccaagggccc<br>ctctgtgtttcctctggccccttgctcccggtccacctctgagtctaccgct-<br>gctctg<br>ggctgcctggtcaaggactactccccgagcctgtgaccgtgtcctggaactctg<br>gcgctctgacctccggcgtgcacacctttccagccgtgctgcagtcctccggcct<br>gtactctctgtcctccgtcgtgaccgtgccctcctccaacttcggcacccagacct<br>acacctgtaacgtggaccacaagccctccaacaccaaggtggacaagaccgtg<br>gaacgaagtcctgcgtggaatgcccttcctgcacctcctgtggctggc<br>ccttccgtgttcctgttccccccaaagcccaaggacaccctgatgatctcccgga<br>cccccgaagtgacctgcgtggtggtggatgtgtcccacgaggaccccgaggtg<br>cagttcaattggtacgtggacggcgtggaagtgcacaacgccaagaccaagcc<br>cagagaggaacagttcaactccaccttccgggtggtgtccgtgctgaccgtggt<br>gcaccaggactggctgaacggcaaagagtacaagtgcaaggtgtccaacaag<br>ggcctgcctgcccccatcgaaaagaccatctccaagacaaagggccagcccc<br>gcgagcctcaggtgtacacactgcctcccagccgggaagagatgaccaagaa<br>ccaggtgtccctgacctgtctggtcaagggcrtctacccctccgatatcgccgtg<br>gaatgggagtccaacggccagcctgagaacaactacaagaccacccccccca<br>tgctggactccgacggctcattcttcctgtactccaagctgacagtggacaagtcc<br>cggtggcagcagggcaacgtgttctcctgctctgtgatgcacgaggccctgcac<br>aaccactacacccagaagtccctgtccctgagccccggcaaa |
| 234 | mAb-CD73.10-Vh-<br>hHC-IgG2-C219S-<br>IgG1.1f | caggtgcagctggtggagtctgggggaggcgtggtccagcctggggaggtccct<br>gagactctcctgtgcagcctctggattcaccttcagtaactatggcatgcactggg<br>tccgccaggctccaggcaaggggctggagtgggtggcagttatatggtatgatg<br>agagtaataaatactatccagactccgtgaagggccgattcaccatctccagaga<br>caattccaagaacacgctgtatctgcaaatgaacagcctgagagccgaggaca<br>cggctgtgtattactgtgcgagaggggggcagcagctggtaccctgattcttttgat<br>atctggggccaaggaacaatggtcaccgtctcttcagcgtcgaccaagggccc<br>atcggtcttccccctggcgccctgctccaggagcacctccgagagcacagcgg<br>ccctgggctgcctggtcaaggactactccccgaaccggtgacggtgtcgtgga<br>actcaggcgctctgaccagcggcgtgcacaccttcccagctgtcctacagtcctc<br>aggactctactccctcagcagcgtggtgaccgtgccctccagcaacttcggcac<br>ccagacctacacctgtagatcacaagcccagcaacaccaaggtggaca<br>agacagttgagcgcaaatcctgtgtcgagtgccaccgtgcccagcaccacctg<br>tggcaggaccgtcagtcttcctcttcccccaaaacccaaggacaccctcatgat<br>ctcccggacccctgaggtcacatgcgtggtggtggacgtgagccacgaagacc<br>ctgaggtcaagttcaactggtacgtggacggcgtggaggtgcataatgccaaga<br>caaagccgcgggaggagcagtacaacagcacgtaccgtgtggtcagcgtcct<br>caccgtcctgcaccaggactggctgaatggcaaggagtacaagtgcaaggtct<br>ccaacaaagcccctcccagcagcatcgagaaaaccatctccaaagccaaagg<br>gcagccccgagaaccacaggtgtacaccctgcccccatcccgggaggagatg<br>accaagaaccaggtcagcctgacctgcctggtcaaaggcttctatcccagcgac |

TABLE 35-continued

| SEQ ID | Description | Sequence |
|---|---|---|
| | | atcgccgtggagtgggagagcaatgggcagccggagaacaactacaagacca cgcctcccgtgctggactccgacggctccttcttcctctatagcaagctcaccgtg gacaagagcaggtggcagcaggggaacgtcttctcatgctccgtgatgcatga ggctctgcacaaccactacacgcagaagagcctctccctgtccccgggtaaa |
| 235 | mAb-CD73.11-Vh-hHC-IgG1.1f | caggtgcagctggtggagtctgggggaggcgtggtccagcctggggaggtccct gagactctcctgtgcagcgtctggattcaccttcagtaactatggcatgcactggg tccgccaggctccaggcaaggggctggagtgggtggcagttatatggtatgatg aaagtaataaatactatgcagactccgtgaagggccgattcaccatctccagaga caattccaagaacacgctgtttctgcaaatgaacagcctgagagccgaggacac ggctgtgtattattgtgcgagagggtataacagcaggtggtaccctgatgcttttg atatctggggccaagggacaatggtcaccgtctcttcagcgtcgaccaagggcc cctccgtgttcctctggcccttccagcaagtccacctctggcggaacagccgc tctgggctgcctggtcaaggactacttccccgagcctgtgaccgtgtcctggaac tctggcgccctgacatctggcgtgcacaccttccctgctgtgctgcagtctagcg gcctgtactccctgtcctccgtcgtgacagtgccctccagctctctgggcaccca gacctacatctgcaacgtgaaccacaagccctccaacaccaaggtggacaagc gggtggaacccaagtcctgcgacaagacccatacctgcccctccctgcctctgctc ctgaagctgaaggcgcccctagcgtgttcctgttccctctccaaagcccaaggaca ccctgatgatctcccggacccctgaagtgacctgcgtggtggtggatgtgtccca cgaggaccccagaagtgaagttcaattggtacgtggacggcgtggaagtgcaca acgccaagaccaagcctagagaggaacagtacaactccacctacgggtggt gtccgtgctgaccgtgctgcaccaggattggctgaacggcaaagagtacaagt gcaaggtgtccaacaaggcccctgcctagctccatcgaaaagaccatctccaag gctaagggccagccccgcgagccccaggtgtacacactgcctccatcccggg aagagatgaccaagaaccaggtgtccctgacttgcctcgtgaagggcttctacc cctccgatatcgccgtggaatgggagtccaacggccagcctgagaacaactac aagaccaccctcccgtgctggactccgacggctcattcttcctgtacagcaagc tgacagtggataagtcccggtggcagcaggggaacgtgttctcctgctccgtga tgcacgaggctctgcacaaccactacacacagaagtcccgtctctgtcccctgg c |
| 236 | mAb-CD73.11-Vh-hHC-IgG2-C219S | caggtgcagctggtggagtctgggggaggcgtggtccagcctggggaggtccct gagactctcctgtgcagcgtctggattcaccttcagtaactatggcatgcactggg tccgccaggctccaggcaaggggctggagtgggtggcagttatatggtatgatg aaagtaataaatactatgcagactccgtgaagggccgattcaccatctccagaga caattccaagaacacgctgtttctgcaaatgaacagcctgagagccgaggacac ggctgtgtattattgtgcgagagggtataacagcaggtggtaccctgatgcttttg atatctggggccaagggacaatggtcaccgtctcttcagcgtcgaccaagggcc cctctgtgtttcctctggccccttgctcccggtccacctctgagtctaccgct-gctct gggctgcctggtcaaggactacttccccgagcctgtgaccgtgtcctggaactct ggcgctctgacctccggcgtgcacacctttccagccgtgctgcagtcctccggc ctgtactctctgtcctccgtcgtgaccgtgccctcctccaacttcggcacccagac ctacacctgtaacgtggaccacaagccctccaacaccaaggtggacaagaccg tggaacggaagtcctgcgtggaatgccctcttgccctgcacctcctgtggctgg cccttccgtgttcctgttccccccaaagcccaaggacaccctgatgatctcccgg accccgaagtgacctgcgtggtggtggatgtgtcccacgaggaccccgaggt gcagttcaattggtacgtggacggcgtggaagtgcacaacgccaagaccaagc ccagagaggaacagttcaactccaccttccgggtggtgtccgtgctgaccgtgg tgcaccaggactggctgaacggcaaagagtacaagtgcaaggtgtccaacaag ggcctgcctgccccatcgaaaagaccatctccaagacaaagggccagcccc gcgagcctcaggtgtacacactgcctccagccgggaagagatgaccaagaa ccaggtgtccctgacctgtctggtcaagggcttctacccctccgatatcgccgtg gaatgggagtccaacggccagcccgagaacaactacaagaccaccccccca tgctggactccgacggctcattcttcctgtactccaagctgacagtggacaagtcc cggtggcagcagggcaacgtgttctcctgctctgtgatgcacgaggccctgcac aaccactacacccagaagtccctgtccctgagccccggcaaa |
| 237 | CD73.4 (VH)- Nucleotide sequence | caggtgcagctggtggagtctgggggaggcgtggtccagcctggggaggtccct gagactctcctgtgcagcctctggattcaccttcagtaactatggcatgcactggg tccgccaggctccaggcaaggggctggagtgggtggcagttatattgtatgatg gaagtaataaatactatccagactccgtgaagggccgattcaccatctccagaga caattccaagaacacgctgtatctgcaaatgaacagcctgagagccgaggaca cggctgtgtattactgtgcgagagggggcagcagctggtaccctgattcttttgat atctggggccaaggaacaatggtcaccgtctcttca |
| 238 | 5F8 VK3 | EIVLTQSPATLSLSPGERATLSCRASQSVSSYLAWY QQKPGQAPRLLIYDASNRATGIPARFSGSGSGTDFT LTISSLEPEDFAVYYCQQRSNWWTFGQGTKVEIK |

TABLE 35-continued

| SEQ ID | Description | Sequence |
|---|---|---|
| 239 | 5F8 VK3 CDR1 | RASQSVSSYLA |
| 240 | 5F8 VK3 CDR2 | DASNRAT |
| 241 | 5F8 VK3 CDR3 | QQRSNWWT |
| 242 | 5F8 VK3-Nucleotide sequence | GAGGTGCAGCTGGTGGAGTCCGGGGGAGGCTTA GTTCAGCCTGGGGGGTCCCTGAGACTCTCCTGTG CAGCCTCTGGATTCACCTTCAGTAGCTACTGGAT GCACTGGGTCCGCCAAGCTCCAGGGAAGGGGCT GGTGTGGGTCTCACGTATTATTAGTGATGGGAGT AGCACAGGTTACGCGGATTCCGTGAAGGGCCGA TTCACCATCTCCAGAGACAACGCCAAGAACACG CTGTATCTGCAAATGAACAGTCTGAGAGCCGAG GACACGGCTGTGTATTACTGTGCAAGAGAGTTTA GCAGTGGCTGGTACTTTGACTACTGGGGCCAGGG AACCCTGGTCACCGTCTCCTCA |
| 243 | 11F11 (full length heavy chain)-NT Seq | CAGGTGCAGCTGGTGGAGTCTGGGGGAGGCGTG GTCCAGCCTGGGAGGTCCCTGAGACTCTCCTGTG CAACGTCTGGATTCACCTTCAGTAACTATGGCAT GCACTGGGTCCGCCAGGCTCCAGGCAAGGGGCT GGAGTGGGTGGCAGTTATATTGTATGATGGAAGT AATAAATACTATCCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGGGGCA GCAGCTGGTACCCTGATTCTTTTGATATCTGGGG CCAAGGAACAATGGTCACCGTCTCTTCAGCCTCC ACCAAGGGCCCATCGGTCTTCCCCCTGGCGCCCT GCTCCAGGAGCACCTCCGAGAGCACAGCGGCCC TGGGCTGCCTGGTCAAGGACTACTTCCCCGAACC GGTGACGGTGTCGTGGAACTCAGGCGCTCTGACC AGCGGCGTGCACACCTTCCCAGCTGTCCTACAGT CCTCAGGACTCTACTCCCTCAGCAGCGTGGTGAC CGTGCCCTCCAGCAACTTCGGCACCCAGACCTAC ACCTGCAACGTAGATCACAAGCCCAGCAACACC AAGGTGGACAAGACAGTTGAGCGCAAATGTTGT GTCGAGTGCCCACCGTGCCCAGCACCACCTGTGG CAGGACCGTCAGTCTTCCTCTTCCCCCCAAAACC CAAGGACACCCTCATGATCTCCCGGACCCCTGAG GTCACGTGCGTGGTGGTGGACGTGAGCCACGAA GACCCCGAGGTCCAGTTCAACTGGTACGTGGAC GGCGTGGAGGTGCATAATGCCAAGACAAAGCCA CGGGAGGAGCAGTTCAACAGCACGTTCCGTGTG GTCAGCGTCCTCACCGTTGTGCACCAGGACTGGC TGAACGGCAAGGAGTACAAGTGCAAGGTCTCCA ACAAAGGCCTCCCAGCCCCCATCGAGAAAACCA TCTCCAAAACCAAAGGGCAGCCCCGAGAACCAC AGGTGTACACCCTGCCCCCATCCCGGGAGGAGA TGACCAAGAACCAGGTCAGCCTGACCTGCCTGGT CAAAGGCTTCTACCCCAGCGACATCGCCGTGGA GTGGGAGAGCAATGGGCAGCCGGAGAACAACTA CAAGACCACACCTCCCATGCTGGACTCCGACGGC TCCTTCTTCCTCTACAGCAAGCTCACCGTGGACA AGAGCAGGTGGCAGCAGGGGAACGTCTTCTCAT GCTCCGTGATGCATGAGGCTCTGCACAACCACTA CACGCAGAAGAGCCTCTCCCTGTCTCCGGGTAAA |
| 244 | 11F11 (full length light chain 1)-NT Seq | GAAATTGTGTTGACACAGTCTCCAGCCACCCTGT CTTTGTCTCCAGGGGAAAGAGCCACCCTCTCCTG CAGGGCCAGTCAGGGTGTTAGCAGCTACTTAGCC TGGTACCAGCAGAAACCTGGCCAGGCTCCCAGG CTCCTCATCTATGATGCATCCAACAGGGCCACTG GCATCCCAGCCAGGTTCAGTGGCAGTGGGCCTG GGACAGACTTCACTCTCACCATCAGCAGCCTAGA GCCTGAAGATTTTGCAGTTTATTACTGTCAGCAG CGTAGCAACTGGCATCTCACTTTCGGCGGAGGGA CCAAGGTGGAGATCAAACGAACTGTGGCTGCAC CATCTGTCTTCATCTTCCCGCCATCTGATGAGCA GTTGAAATCTGGAACTGCCTCTGTTGTGTGCCTG CTGAATAACTTCTATCCCAGAGAGGCCAAAGTAC AGTGGAAGGTGGATAACGCCCTCCAATCGGGTA ACTCCCAGGAGAGTGTCACAGAGCAGGACAGCA AGGACAGCACCTACAGCCTCAGCAGCACCCTGA CGCTGAGCAAAGCAGACTACGAGAAACACAAAG |

TABLE 35-continued

| SEQ ID | Description | Sequence |
|---|---|---|
| | | TCTACGCCTGCGAAGTCACCCATCAGGGCCTGAG<br>CTCGCCCGTCACAAAGAGCTTCAACAGGGGAGA<br>GTGT |
| 245 | 11F11 (full length light chain 2)-NT Seq | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCTCTCACTTTCGGCGGAGGGA<br>CCAAGGTGGAGATCAAACGAACTGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTAC<br>AGTGGAAGGTGGATAACGCCCTCCAATCGGGTA<br>ACTCCCAGGAGAGTGTCACAGAGCAGGACAGCA<br>AGGACAGCACCTACAGCCTCAGCAGCACCCTGA<br>CGCTGAGCAAAGCAGACTACGAGAAACACAAAG<br>TCTACGCCTGCGAAGTCACCCATCAGGGCCTGAG<br>CTCGCCCGTCACAAAGAGCTTCAACAGGGGAGA<br>GTGT |
| 246 | 4C3 (full length heavy chain)-NT Seq | GAAGTGCAGCTGGTGGAGTCTGGGGGAGGCTTG<br>GTACAGCCTGGCAGGTCCCTGAGACTCTCCTGTG<br>CAGCCTCTGGATTCACCTTTGATGATTATGCCAT<br>GCACTGGGTCCGGCAAGCTCCAGGGAAGGGCCT<br>GGAGTGGGTCTCAGGTATTAGTTGGAAGAGTGG<br>TAGCATAGGCTATGCGGACTCTGTGAAGGGCCG<br>ATTCACCATCTCCAGAGACAACGCCAAGAACTCC<br>CTGTATCTGCAAATGAACAGTCTGAGAGCTGAG<br>GACACGGCCTTGTATTACTGTGTAAAAGGGTATT<br>ACGTTATTTTGACTGGCCTTGACTACTGGGGCCA<br>GGGAACCCTGGTCACCGTCTCCTCAGccTccAccAA<br>GGGCCCATCGGTCTTCCCCCTGGCACCCTCCTCCAAGAGCACC<br>TCTGGGGGCACAGCGGCCCTGGGCTGCCTGGTCAAGGACTAC<br>TTCCCCGAACCGGTGACGGTGTCGTGGAACTCAGGCGCCCTG<br>ACCAGCGGCGTGCACACCTTCCCGGCTGTCCTACAGTCCTCA<br>GGACTCTACTCCCTCAGCAGCGTGGTGACCGTGCCCTCCAGC<br>AGCTTGGGCACCCAGACCTACATCTGCAACGTGAATCACAAG<br>CCCAGCAACACCAAGGTGGACAAGAAAGTTGAGCCCAAATCT<br>TGTGACAAAACTCACACATGCCCACCGTGCCCAGCACCTGAA<br>CTCCTGGGGGGACCGTCAGTCTTCCTCTTCCCCCCAAAACCCA<br>AGGACACCCTCATGATCTCCCGGACCCCTGAGGTCACATGCG<br>TGGTGGTGGACGTGAGCCACGAAGACCCTGAGGTCAAGTTCA<br>ACTGGTACGTGGACGGCGTGGAGGTGCATAATGCCAAGACAA<br>AGCCGCGGGAGGAGCAGTACAACAGCACGTACCGTGTGGTC<br>AGCGTCCTCACCGTCCTGCACCAGGACTGGCTGAATGGCAAG<br>GAGTACAAGTGCAAGGTCTCCAACAAAGCCCTCCCAGCCCCC<br>ATCGAGAAAACCATCTCCAAAGCCAAAGGGCAGCCCCGAGA<br>ACCACAGGTGTACACCCTGCCCCCATCCCGGGATGAGCTGAC<br>CAAGAACCAGGTCAGCCTGACCTGCCTGGTCAAAGGCTTCTA<br>TCCCAGCGACATCGCCGTGGAGTGGGAGAGCAATGGGCAGCC<br>GGAGAACAACTACAAGACCACGCCTCCCGTGCTGGACTCCGA<br>CGGCTCCTTCTTCCTCTACAGCAAGCTCACCGTGGACAAGAG<br>CAGGTGGCAGCAGGGGAACGTCTTCTCATGCTCCGTGATGCA<br>TGAGGCTCTGCACAACCACTACACGCAGAAGAGCCTCTCCCT<br>GTCTCCGGGTAAA |
| 247 | 4C3 (full length light chain 1)-NT Seq | GAAATTGTGTTGACGCAGTCTCCAGGCACCCTGT<br>CTTTGTCTCCAGGGGAAAGAGCCACCCTCTCCTG<br>CAGGGCCAGTCAGAGTGTTAGCAGCTACTTAGCC<br>TGGTACCAGCAGAAACCTGGCCAGGCTCCCAGG<br>CTCCTCATCTATGGTGCATCCAGCAGGGCCACTG<br>GCATCCCAGACAGGTTCAGTGGCAGTGGGTCTG<br>GGACAGACTTCACTCTCACCATCAGCAGACTGGA<br>GCCTGAAGATTTTGCAGTGTATTACTGTCAGCAG<br>TATGGTAGCTCACCGCTCACTTTCGGCGGAGGGA<br>CCAAGGTGGAGATCAAACGAACTGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTAC<br>AGTGGAAGGTGGATAACGCCCTCCAATCGGGTA<br>ACTCCCAGGAGAGTGTCACAGAGCAGGACAGCA<br>AGGACAGCACCTACAGCCTCAGCAGCACCCTGA |

TABLE 35-continued

| SEQ ID Description | Sequence |
|---|---|
| | CGCTGAGCAAAGCAGACTACGAGAAACACAAAG<br>TCTACGCCTGCGAAGTCACCCATCAGGGCCTGAG<br>CTCGCCCGTCACAAAGAGCTTCAACAGGGGAGA<br>GTGT |
| 248 4C3 (full length light chain 2)-NT Seq | GACATCCAGATGACCCAGTCTCCATCCTCACTGT<br>CTGCATCTGTAGGAGACAGAGTCACCTTCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCTCCAACGTTCGGCCAGGGGA<br>CCAAGGTGGAAATCAAACGAACTGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTAC<br>AGTGGAAGGTGGATAACGCCCTCCAATCGGGTA<br>ACTCCCAGGAGAGTGTCACAGAGCAGGACAGCA<br>AGGACAGCACCTACAGCCTCAGCAGCACCCTGA<br>CGCTGAGCAAAGCAGACTACGAGAAACACAAAG<br>TCTACGCCTGCGAAGTCACCCATCAGGGCCTGAG<br>CTCGCCCGTCACAAAGAGCTTCAACAGGGGAGA<br>GTGT |
| 249 4C3 (full length light chain 3)-NT Seq | GACATCCAGATGACCCAGTCTCCATCCTCACTGT<br>CTGCATCTGTAGGAGACAGAGTCACCTTCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCTCCAACGTTCGGCCAAGGGA<br>CCAAGGTGGAAATCAAACGAACTGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTAC<br>AGTGGAAGGTGGATAACGCCCTCCAATCGGGTA<br>ACTCCCAGGAGAGTGTCACAGAGCAGGACAGCA<br>AGGACAGCACCTACAGCCTCAGCAGCACCCTGA<br>CGCTGAGCAAAGCAGACTACGAGAAACACAAAG<br>TCTACGCCTGCGAAGTCACCCATCAGGGCCTGAG<br>CTCGCCCGTCACAAAGAGCTTCAACAGGGGAGA<br>GTGT |
| 250 4D4 (full length heavy chain)-NT Seq | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAACTATGGCAT<br>GCACTGGGTCCGCCAGGCTCCAGGCAAGGGGCT<br>GGAGTGGGTGGCAGTTATATGGTATGATGAAAG<br>TAATAAATACTATGCAGACTCCGTGAAGGGCCG<br>ATTCACCATCTCCAGAGACAATTCCAAGAACACG<br>CTGTTTCTGCAAATGAACAGCCTGAGAGCCGAG<br>GACACGGCTGTGTATTATTGTGCGAGAGGGTATA<br>ACAGCAGGTGGTACCCTGATGCTTTTGATATCTG<br>GGGCCAAGGGACAATGGTCACCGTCTCTTCAGCC<br>TCCACCAAGGGCCCATCGGTCTTCCCCCTGGCGC<br>CCTGCTCCAGGAGCACCTCCGAGAGCACAGCGG<br>CCCTGGGCTGCCTGGTCAAGGACTACTTCCCCGA<br>ACCGGTGACGGTGTCGTGGAACTCAGGCGCTCTG<br>ACCAGCGGCGTGCACACCTTCCCAGCTGTCCTAC<br>AGTCCTCAGGACTCTACTCCCTCAGCAGCGTGGT<br>GACCGTGCCCTCCAGCAACTTCGGCACCCAGACC<br>TACACCTGCAACGTAGATCACAAGCCCAGCAAC<br>ACCAAGGTGGACAAGACAGTTGAGCGCAAATGT<br>TGTGTCGAGTGCCCACCGTGCCCAGCACCACCTG<br>TGGCAGGACCGTCAGTCTTCCTCTTCCCCCCAAA<br>ACCCAAGGACACCCTCATGATCTCCCGGACCCCT<br>GAGGTCACGTGCGTGGTGGTGGACGTGAGCCAC<br>GAAGACCCCGAGGTCCAGTTCAACTGGTACGTG<br>GACGGCGTGGAGGTGCATAATGCCAAGACAAAG<br>CCACGGGAGGAGCAGTTCAACAGCACGTTCCGT<br>GTGGTCAGCGTCCTCACCGTTGTGCACCAGGACT<br>GGCTGAACGGCAAGGAGTACAAGTGCAAGGTCT<br>CCAACAAAGGCCTCCCAGCCCCCATCGAGAAAA |

TABLE 35-continued

| SEQ ID Description | Sequence |
|---|---|
| | CCATCTCCAAAACCAAAGGGCAGCCCCGAGAAC<br>CACAGGTGTACACCCTGCCCCCATCCCGGGAGG<br>AGATGACCAAGAACCAGGTCAGCCTGACCTGCC<br>TGGTCAAAGGCTTCTACCCCAGCGACATCGCCGT<br>GGAGTGGGAGAGCAATGGGCAGCCGGAGAACA<br>ACTACAAGACCACACCTCCCATGCTGGACTCCGA<br>CGGCTCCTTCTTCCTCTACAGCAAGCTCACCGTG<br>GACAAGAGCAGGTGGCAGCAGGGGAACGTCTTC<br>TCATGCTCCGTGATGCATGAGGCTCTGCACAACC<br>ACTACACGCAGAAGAGCCTCTCCCTGTCTCCGGG<br>TAAA |
| 2514D4 (full length light chain 1)-NT Seq | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCGCTCACTTTCGGCGGAGGGA<br>CCAAGGTGGAGATCAAACGAACTGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTAC<br>AGTGGAAGGTGGATAACGCCCTCCAATCGGGTA<br>ACTCCCAGGAGAGTGTCACAGAGCAGGACAGCA<br>AGGACAGCACCTACAGCCTCAGCAGCACCCTGA<br>CGCTGAGCAAAGCAGACTACGAGAAACACAAAG<br>TCTACGCCTGCGAAGTCACCCATCAGGGCCTGAG<br>CTCGCCCGTCACAAAGAGCTTCAACAGGGGAGA<br>GTGT |
| 252 10D2 (full length heavy chain)-NT Seq | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAACTATGGCCT<br>GCACTGGGTCCGCCAGGCTCCAGGCAAGGGGCT<br>GGAGTGGGTGGCAGTTATACGGTATGATGGAAG<br>TAATAAATACTATGCAGACTCCGTGAAGGGCCG<br>ATTCACCATCTCCAGAGACAATTCCAAGAACACG<br>CTGTATCTGCAAATGAGCAGCCTGAGAGCCGAG<br>GACACGGCTGTGTATTACTGTGCGAGGGGGGGC<br>AGCAGCTGGTACCCGGACGGTTTGGACGTCTGG<br>GGCCAAGGGACCACGGTCACCGTCTCCTCAGCTT<br>CCACCAAGGGCCCATCCGTCTTCCCCCTGGCGCC<br>CTGCTCCAGGAGCACCTCCGAGAGCACAGCCGC<br>CCTGGGCTGCCTGGTCAAGGACTACTTCCCCGAA<br>CCGGTGACGGTGTCGTGGAACTCAGGCGCCCTG<br>ACCAGCGGCGTGCACACCTTCCCGGCTGTCCTAC<br>AGTCCTCAGGACTCTACTCCCTCAGCAGCGTGGT<br>GACCGTGCCCTCCAGCAGCTTGGGCACGAAGAC<br>CTACACCTGCAACGTAGATCACAAGCCCAGCAA<br>CACCAAGGTGGACAAGAGAGTTGAGTCCAAATA<br>TGGTCCCCCATGCCCATCATGCCCAGCACCTGAG<br>TTCCTGGGGGGACCATCAGTCTTCCTGTTCCCCC<br>CAAAACCCAAGGACACTCTCATGATCTCCCGGAC<br>CCCTGAGGTCACGTGCGTGGTGGTGGACGTGAG<br>CCAGGAAGACCCCGAGGTCCAGTTCAACTGGTA<br>CGTGGATGGCGTGGAGGTGCATAATGCCAAGAC<br>AAAGCCGCGGGAGGAGCAGTTCAACAGCACGTA<br>CCGTGTGGTCAGCGTCCTCACCGTCCTGCACCAG<br>GACTGGCTGAACGGCAAGGAGTACAAGTGCAAG<br>GTCTCCAACAAAGGCCTCCCGTCCTCCATCGAGA<br>AAACCATCTCCAAAGCCAAAGGGCAGCCCCGAG<br>AGCCACAGGTGTACACCCTGCCCCCATCCCAGGA<br>GGGAGATGACCAAGAACCAGGTCAGCCTGACCTG<br>CCTGGTCAAAGGCTTCTACCCCAGCGACATCGCC<br>GTGGAGTGGGAGAGCAATGGGCAGCCGGAGAAC<br>AACTACAAGACCACGCCTCCCGTGCTGGACTCCG<br>ACGGCTCCTTCTTCCTCTACAGCAGGCTAACCGT<br>GGACAAGAGCAGGTGGCAGGAGGGGAATGTCTT<br>CTCATGCTCCGTGATGCATGAGGCTCTGCACAAC<br>CACTACACACAGAAGAGCCTCTCCCTGTCTCTGG<br>GTAAA |

TABLE 35-continued

| SEQ ID | Description | Sequence |
|---|---|---|
| 253 | 10D2 (full length light chain 1)-NT Seq | GCCATCCAGTTGACCCAGTCTCCATCCTCCCTGT<br>CTGCATCTGTAGGAGACAGAGTCACCATCACTTG<br>CCGGGCAAGTCAGGGCATTAGCAGTGCTTTAGCC<br>TGGTATCAGCAGAAACCAGGGAAAGCTCCTAAG<br>CTCCTGATCTATGATGCCTCCAGTTTGGAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGTCAACAG<br>TTTAATAGTTACCCCACTTTCGGCGGAGGGACCA<br>AGGTGGAGATCAAACGAACTGTGGCTGCACCAT<br>CTGTCTTCATCTTCCCGCCATCTGATGAGCAGTT<br>GAAATCTGGAACTGCCTCTGTTGTGTGCCTGCTG<br>AATAACTTCTATCCCAGAGAGGCCAAAGTACAG<br>TGGAAGGTGGATAACGCCCTCCAATCGGGTAAC<br>TCCCAGGAGAGTGTCACAGAGCAGGACAGCAAG<br>GACAGCACCTACAGCCTCAGCAGCACCCTGACG<br>CTGAGCAAAGCAGACTACGAGAAACACAAAGTC<br>TACGCCTGCGAAGTCACCCATCAGGGCCTGAGCT<br>CGCCCGTCACAAAGAGCTTCAACAGGGGAGAGT<br>GT |
| 254 | 10D2 (full length light chain 2)-NT Seq | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCGCTCACTTTCGGCGGAGGGA<br>CCAAGGTGGAGATCAAACGAACTGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTAC<br>AGTGGAAGGTGGATAACGCCCTCCAATCGGGTA<br>ACTCCCAGGAGAGTGTCACAGAGCAGGACAGCA<br>AGGACAGCACCTACAGCCTCAGCAGCACCCTGA<br>CGCTGAGCAAAGCAGACTACGAGAAACACAAAG<br>TCTACGCCTGCGAAGTCACCCATCAGGGCCTGAG<br>CTCGCCCGTCACAAAGAGCTTCAACAGGGGAGA<br>GTGT |
| 255 | 11A6 (full length heavy chain)-NT Seq | GAAGTGCAGCTGGTGGAATCTGGGGGAAACTTG<br>GTACAGCCTGGCAGGTCCCTGAGACTCTCCTGTG<br>CAGCCTCTGGATTCACCTTTGATGATTATGCCAT<br>GCACTGGGTCCGGCAAGCTCCAGGGAAGGGCCT<br>GGAGTGGGTCTCAGGTATTAGTTGGAATAATAAT<br>GACATAGGCTATGCGGACTCTGTGAAGGGCCGA<br>TTCATCATCTCCAGAGACAACGCCAAGAACTCCC<br>TGTATCTGCAAATGAACAGTCTGAGACCTGAGG<br>ACACGGCCTTGTATTATTGTGTAAAAGGTTATTA<br>CGTTATTTTGACTGGTCTTGACTACTGGGGCCAG<br>GGAACCCCGGTCACCGTCTCCTCAGCCTCCACCAAG<br>GGCCCATCGGTCTTCCCCCTGGCACCCTCCTCCAAGAGCACCT<br>CTGGGGGCACAGCGGCCCTGGGCTGCCTGGTCAAGGACTACT<br>TCCCCGAACCGGTGACGGTGTCGTGGAACTCAGGCGCCCTGA<br>CCAGCGGCGTGCACACCTTCCCGGCTGTCCTACAGTCCTCAG<br>GACTCTACTCCCTCAGCAGCGTGGTGACCGTGCCCTCCAGCA<br>GCTTGGGCACCCAGACCTACATCTGCAACGTGAATCACAAGC<br>CCAGCAACACCAAGGTGGACAAGAAAGTTGAGCCCAAATCTT<br>GTGACAAAACTCACACATGCCCACCGTGCCCAGCACCTGAAC<br>TCCTGGGGGGACCGTCAGTCTTCCTCTTCCCCCCAAAACCCAA<br>GGACACCCTCATGATCTCCCGGACCCCTGAGGTCACATGCGT<br>GGTGGTGGACGTGAGCCACGAAGACCCTGAGGTCAAGTTCAA<br>CTGGTACGTGGACGGCGTGGAGGTGCATAATGCCAAGACAAA<br>GCCGCGGGAGGAGCAGTACAACAGCACGTACCGTGTGGTCA<br>GCGTCCTCACCGTCCTGCACCAGGACTGGCTGAATGGCAAGG<br>AGTACAAGTGCAAGGTCTCCAACAAAGCCCTCCCAGCCCCCA<br>TCGAGAAAACCATCTCCAAAGCCAAAGGGCAGCCCCGAGAA<br>CCACAGGTGTACACCCTGCCCCCATCCCGGGATGAGCTGACC<br>AAGAACCAGGTCAGCCTGACCTGCCTGGTCAAAGGCTTCTAT<br>CCCAGCGACATCGCCGTGGAGTGGGAGAGCAATGGGCAGCC<br>GGAGAACAACTACAAGACCACGCCTCCCGTGCTGGACTCCGA<br>CGGCTCCTTCTTCCTCTACAGCAAGCTCACCGTGGACAAGAG<br>CAGGTGGCAGCAGGGGAACGTCTTCTCATGCTCCGTGATGCA |

| SEQ ID | Description | Sequence |
|---|---|---|
| | | TGAGGCTCTGCACAACCACTACACGCAGAAGAGCCTCTCCCT<br>GTCTCCGGGTAAA |
| 256 | 11A6 (full length light chain 1)-NT Seq | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCGCTCACTTTCGGCGGAGGGA<br>CCAAGGTGGAGATCAAACGAACTGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTAC<br>AGTGGAAGGTGGATAACGCCCTCCAATCGGGTA<br>ACTCCCAGGAGAGTGTCACAGAGCAGGACAGCA<br>AGGACAGCACCTACAGCCTCAGCAGCACCCTGA<br>CGCTGAGCAAAGCAGACTACGAGAAACACAAAG<br>TCTACGCCTGCGAAGTCACCCATCAGGGCCTGAG<br>CTCGCCCGTCACAAAGAGCTTCAACAGGGGAGA<br>GTGT |
| 257 | 24H2 (full length heavy chain)-NT Seq | CAGGTGCAACTGGTGGAGTCTGGGGGAGGCGTG<br>GTCCAGCCTGGGAGGTCCCTGAGACTCTCCTGTG<br>CAGCGTCTGGATTCACCTTCAGTAACTATGGCAT<br>GCACTGGGTCCGCCAGGCTCCAGGCAAGGGGCT<br>GGAGTGGGTGGCAGTTATATGGTATGATGGAGG<br>TAATAAATACTATGCAGACTCCGTGAAGGGCCG<br>ATTCACCATCTCCAGAGACAATTCCAAGAACACG<br>CTGTTTCTGCAAATGAACAGCCTGAGAGCCGAA<br>GACACGGCTGTGTATTACTGTGCGAGAGGGGGC<br>AGCAGCTGGTACCCTGATGCTTTTGATATCTGGG<br>GCCAAGGGACAATGGTCACCGTCTCTTCAGCTTC<br>CACCAAGGGCCCATCCGTCTTCCCCCTGGCGCCC<br>TGCTCCAGGAGCACCTCCGAGAGCACAGCCGCC<br>CTGGGCTGCCTGGTCAAGGACTACTTCCCCGAAC<br>CGGTGACGGTGTCGTGGAACTCAGGCGCCCTGA<br>CCAGCGGCGTGCACACCTTCCCGGCTGTCCTACA<br>GTCCTCAGGACTCTACTCCCTCAGCAGCGTGGTG<br>ACCGTGCCCTCCAGCAGCTTGGGCACGAAGACCT<br>ACACCTGCAACGTAGATCACAAGCCCAGCAACA<br>CCAAGGTGGACAAGAGAGTTGAGTCCAAATATG<br>GTCCCCCATGCCCATCATGCCCAGCACCTGAGTT<br>CCTGGGGGGACCATCAGTCTTCCTGTTCCCCCCA<br>AAACCCAAGGACACTCTCATGATCTCCCGGACCC<br>CTGAGGTCACGTGCGTGGTGGTGGACGTGAGCC<br>AGGAAGACCCCGAGGTCCAGTTCAACTGGTACG<br>TGGATGGCGTGGAGGTGCATAATGCCAAGACAA<br>AGCCGCGGGAGGAGCAGTTCAACAGCACGTACC<br>GTGTGGTCAGCGTCCTCACCGTCCTGCACCAGGA<br>CTGGCTGAACGGCAAGGAGTACAAGTGCAAGGT<br>CTCCAACAAAGGCCTCCCGTCCTCCATCGAGAAA<br>ACCATCTCCAAAGCCAAAGGGCAGCCCCGAGAG<br>CCACAGGTGTACACCCTGCCCCCATCCCAGGAGG<br>AGATGACCAAGAACCAGGTCAGCCTGACCTGCC<br>TGGTCAAAGGCTTCTACCCCAGCGACATCGCCGT<br>GGAGTGGGAGAGCAATGGGCAGCCGGAGAACA<br>ACTACAAGACCACGCCTCCCGTGCTGGACTCCGA<br>CGGCTCCTTCTTCCTCTACAGCAGGCTAACCGTG<br>GACAAGAGCAGGTGGCAGGAGGGGAATGTCTTC<br>TCATGCTCCGTGATGCATGAGGCTCTGCACAACC<br>ACTACACACAGAAGAGCCTCTCCCTGTCTCTGGG<br>TAAA |
| 258 | 24H2 (full length light chain 1)-NT Seq | GACATCCAGATGACCCAGTCTCCATCCTCACTGT<br>CTGCATCTGTAGGAGACAGAGTCACCATCACTTG<br>TCGGGCGAGTCAGGGTATTAGCAGCTGGTTAGCC<br>TGGTATCAGCAGAAACCAGAGAAAGCCCCTAAG<br>TCCCTGATCTATGCTGCATCCAGTTTGCAAAGTG<br>GGGTCCCATCAAGGTTCAGCGGCAGTGGATCTG<br>GGACAGATTTCACTCTCACCATCAGCAGCCTGCA<br>GCCTGAAGATTTTGCAACTTATTACTGCCAACAG<br>TATAATAGTTACCCTCTCACTTTCGGCGGAGGGA<br>CCAAGGTGGAGATCAAACGAACTGTGGCTGCAC<br>CATCTGTCTTCATCTTCCCGCCATCTGATGAGCA |

TABLE 35-continued

| SEQ ID | Description | Sequence |
|---|---|---|
| | | GTTGAAATCTGGAACTGCCTCTGTTGTGTGCCTG CTGAATAACTTCTATCCCAGAGAGGCCAAAGTAC AGTGGAAGGTGGATAACGCCCTCCAATCGGGTA ACTCCCAGGAGAGTGTCACAGAGCAGGACAGCA AGGACAGCACCTACAGCCTCAGCAGCACCCTGA CGCTGAGCAAAGCAGACTACGAGAAACACAAAG TCTACGCCTGCGAAGTCACCCATCAGGGCCTGAG CTCGCCCGTCACAAAGAGCTTCAACAGGGGAGA GTGT |
| 259 | 5F8 (full length heavy chain)-NT Seq | GAGGTGCAGCTGGTGGAGTCCGGGGGAGGCTTA GTTCAGCCTGGGGGGTCCCTGAGACTCTCCTGTG CAGCCTCTGGATTCACCTTCAGTAGCTACTGGAT GCACTGGGTCCGCCAAGCTCCAGGGAAGGGGCT GGTGTGGGTCTCACGTATTATTAGTGATGGGAGT AGCACAGGTTACGCGGATTCCGTGAAGGGCCGA TTCACCATCTCCAGAGACAACGCCAAGAACACG CTGTATCTGCAAATGAACAGTCTGAGAGCCGAG GACACGGCTGTGTATTACTGTGCAAGAGAGTTTA GCAGTGGCTGGTACTTTGACTACTGGGGCCAGGG AACCCTGGTCACCGTCTCCTCAGccTccAccAAGGGC CCATCGGTCTTCCCCCTGGCACCCTCCTCCAAGAGCACCTCTG GGGGCACAGCGGCCCTGGGCTGCCTGGTCAAGGACTACTTCC CCGAACCGGTGACGGTGTCGTGGAACTCAGGCGCCCTGACCA GCGGCGTGCACACCTTCCCGGCTGTCCTACAGTCCTCAGGACT CTACTCCCTCAGCAGCGTGGTGACCGTGCCCTCCAGCAGCTTG GGCACCCAGACCTACATCTGCAACGTGAATCACAAGCCCAGC AACACCAAGGTGGACAAGAAAGTTGAGCCCAAATCTTGTGAC AAAACTCACACATGCCCACCGTGCCCAGCACCTGAACTCCTG GGGGGACCGTCAGTCTTCCTCTTCCCCCCAAAACCCAAGGAC ACCCTCATGATCTCCCGGACCCCTGAGGTCACATGCGTGGTG GTGGACGTGAGCCACGAAGACCCTGAGGTCAAGTTCAACTGG TACGTGGACGGCGTGGAGGTGCATAATGCCAAGACAAAGCC GCGGGAGGAGCAGTACAACAGCACGTACCGTGTGGTCAGCGT CCTCACCGTCCTGCACCAGGACTGGCTGAATGGCAAGGAGTA CAAGTGCAAGGTCTCCAACAAAGCCCTCCCAGCCCCCATCGA GAAAACCATCTCCAAAGCCAAAGGGCAGCCCCGAGAACCAC AGGTGTACACCCTGCCCCCATCCCGGGATGAGCTGACCAAGA ACCAGGTCAGCCTGACCTGCCTGGTCAAAGGCTTCTATCCCA GCGACATCGCCGTGGAGTGGGAGAGCAATGGGCAGCCGGAG AACAACTACAAGACCACGCCTCCCGTGCTGGACTCCGACGGC TCCTTCTTCCTCTACAGCAAGCTCACCGTGGACAAGAGCAGG TGGCAGCAGGGGAACGTCTTCTCATGCTCCGTGATGCATGAG GCTCTGCACAACCACTACACGCAGAAGAGCCTCTCCCTGTCT CCGGGTAAA |
| 260 | 5F8 (full length light chain 1)-NT Seq | GCCATCCAGTTGACCCAGTCTCCATCCTCCCTGT CTGCATCTGTAGGAGACAGAGTCACCATCACTTG CCGGGCAAGTCAGGGCATTAGCAGTGCTTTAGCC TGGTATCAGCAGAAACCAGGGAAAGCTCCTAAG CTCCTGATCTATGATGCCTCCAGTTTGGAAAGTG GGGTCCCATCAAGGTTCAGCGGCAGTGGATCTG GGACAGATTTCACTCTCACCATCAGCAGCCTGCA GCCTGAAGATTTTGCAACTTATTACTGTCAACAG TTTAGTAGTTACCCTCGGACGTTCGGCCAAGGGA CCAAGGTGGAAATCAAACGAACTGTGGCTGCAC CATCTGTCTTCATCTTCCCGCCATCTGATGAGCA GTTGAAATCTGGAACTGCCTCTGTTGTGTGCCTG CTGAATAACTTCTATCCCAGAGAGGCCAAAGTAC AGTGGAAGGTGGATAACGCCCTCCAATCGGGTA ACTCCCAGGAGAGTGTCACAGAGCAGGACAGCA AGGACAGCACCTACAGCCTCAGCAGCACCCTGA CGCTGAGCAAAGCAGACTACGAGAAACACAAAG TCTACGCCTGCGAAGTCACCCATCAGGGCCTGAG CTCGCCCGTCACAAAGAGCTTCAACAGGGGAGA GTGT |
| 261 | 5F8 (full length light chain 2)-NT Seq | GACATCCAGATGACCCAGTCTCCATCCTCACTGT CTGCATCTGTAGGAGACAGAGTCACCATCACTTG TCGGGCGAGTCAGGGTATTAGCAGCTGGTTAGCC TGGTATCAGCAGAAACCAGAGAAAGCCCCTAAG TCCCTGATCTATGCTGCATCCAGTTTGCAAAGTG GGGTCCCATCAAGGTTCAGCGGCAGTGGATCTG GGACAGGTTTCACTCTCACCATCAGCAGCCTGCA GCCTGAAGATTTTGCAACTTATTACTGCCAACAG TATAATAGTTACCCTCGGACGTTCGGCCAAGGGA CCAAGGTGGAAATCAAACGAACTGTGGCTGCAC |

TABLE 35-continued

| SEQ ID | Description | Sequence |
|---|---|---|
| | | CATCTGTCTTCATCTTCCCGCCATCTGATGAGCA
GTTGAAATCTGGAACTGCCTCTGTTGTGTGCCTG
CTGAATAACTTCTATCCCAGAGAGGCCAAAGTAC
AGTGGAAGGTGGATAACGCCCTCCAATCGGGTA
ACTCCCAGGAGAGTGTCACAGAGCAGGACAGCA
AGGACAGCACCTACAGCCTCAGCAGCACCCTGA
CGCTGAGCAAAGCAGACTACGAGAAACACAAAG
TCTACGCCTGCGAAGTCACCCATCAGGGCCTGAG
CTCGCCCGTCACAAAGAGCTTCAACAGGGGAGA
GTGT |
| 262 | 6E11 (full length heavy chain)-NT Seq | GAAGTGCAGCTGGTGGAGTCTGGGGGAGCCTTG
GTACAGCCTGGCAGGTCCCTGAGACTCTCCTGTG
CAGCCTCTGGATTCACCTTTGATGATTATGCCAT
GCACTGGGTCCGGCAAGCTCCAGGGAAGGGCCT
GGAGTGGGTCTCAGGTATTACTTGGAATAGTGGT
GGCATAGGCTACGCGGACTCTGTGAAGGGCCGA
TTCACCATCTCCAGAGACAACGCCAAGAACTCCC
TGTATCTGCAAATGAACAGTCTGAGAGCTGAGG
ACACGGCCTTGTATTACTGTGCAAAAGATAGGTA
TTACAGCAGTTGGCTCCTCTTTGACAACTGGGGC
CAGGGAATTCTGGTCACCGTCTCCTCAGccTccAcc
AAGGGCCCATCGGTCTTCCCCCTGGCACCCTCCTCCAAGAGC
ACCTCTGGGGGCACAGCGGCCCTGGGCTGCCTGGTCAAGGAC
TACTTCCCCGAACCGGTGACGGTGTCGTGGAACTCAGGCGCC
CTGACCAGCGGCGTGCACACCTTCCCGGCTGTCCTACAGTCCT
CAGGACTCTACTCCCTCAGCAGCGTGGTGACCGTGCCCTCCA
GCAGCTTGGGCACCCAGACCTACATCTGCAACGTGAATCACA
AGCCCAGCAACACCAAGGTGGACAAGAAAGTTGAGCCCAAA
TCTTGTGACAAAACTCACACATGCCCACCGTGCCCAGCACCT
GAACTCCTGGGGGGACCGTCAGTCTTCCTCTTCCCCCCAAAAC
CCAAGGACACCCTCATGATCTCCCGGACCCCTGAGGTCACAT
GCGTGGTGGTGGACGTGAGCCACGAAGACCCTGAGGTCAAGT
TCAACTGGTACGTGGACGGCGTGGAGGTGCATAATGCCAAGA
CAAAGCCGCGGGAGGAGCAGTACAACAGCACGTACCGTGTG
GTCAGCGTCCTCACCGTCCTGCACCAGGACTGGCTGAATGGC
AAGGAGTACAAGTGCAAGGTCTCCAACAAAGCCCTCCCAGCC
CCCATCGAGAAAACCATCTCCAAAGCCAAAGGGCAGCCCCGA
GAACCACAGGTGTACACCCTGCCCCCATCCCGGGATGAGCTG
ACCAAGAACCAGGTCAGCCTGACCTGCCTGGTCAAAGGCTTC
TATCCCAGCGACATCGCCGTGGAGTGGGAGAGCAATGGGCAG
CCGGAGAACAACTACAAGACCACGCCTCCCGTGCTGGACTCC
GACGGCTCCTTCTTCCTCTACAGCAAGCTCACCGTGGACAAG
AGCAGGTGGCAGCAGGGGAACGTCTTCTCATGCTCCGTGATG
CATGAGGCTCTGCACAACCACTACACGCAGAAGAGCCTCTCC
CTGTCTCCGGGTAAA |
| 263 | 6E11 (full length light chain 1)-NT Seq | GAAATTGTGTTGACGCAGTCTCCAGGCACCCTGT
CTTTGTCTCCAGGGGAAAGAGCCACCCTCTCCTG
CAGGGCCAGTCAGAGTGTTAGCAGCAGCTACTT
AGCCTGGTACCAGCAGAAACCTGGCCAGGCTCC
CAGGCTCCTCATCTATGGTGCATCCAGCAGGGCC
ACTGGCATCCCAGACAGGTTCAGTGGCAGTGGG
TCTGGGACAGACTTCACTCTCACCATCAGCAGAC
TGGAGCCTGAAGATTTTGCAGTGTATTACTGTCA
GCATTATGGTAGCTCATTCACTTTCGGCCCTGGG
ACCAAAGTGGATATCAAACGAACTGTGGCTGCA
CCATCTGTCTTCATCTTCCCGCCATCTGATGAGC
AGTTGAAATCTGGAACTGCCTCTGTTGTGTGCCT
GCTGAATAACTTCTATCCCAGAGAGGCCAAAGT
ACAGTGGAAGGTGGATAACGCCCTCCAATCGGG
TAACTCCCAGGAGAGTGTCACAGAGCAGGACAG
CAAGGACAGCACCTACAGCCTCAGCAGCACCCT
GACGCTGAGCAAAGCAGACTACGAGAAACACAA
AGTCTACGCCTGCGAAGTCACCCATCAGGGCCTG
AGCTCGCCCGTCACAAAGAGCTTCAACAGGGGA
GAGTGT |
| 264 | 7A11 (full length heavy chain)-NT Seq | GAAGTGCAGCTGGTGGAGTCTGGGGGAGGCTTG
GTACAGACTGGCAGGTCCCTGAGACTCTCCTGTG
CAGCCTCTGGATTCACCTTTGATGATTATGCCAT
GCACTGGGTCCGGCAAGCTCCAGGGAAGGGCCT
GGAGTGGGTCTCAGATATTAGTTGGAATAGTGAT
ATTATAGGCTATGCGGACTCTGTGAAGGGCCGAT
TCACCATCTCTAGAGACAACGCCAAGAACTCCCT
GTATCTGCAAATGAACAGTCTGAGAGCTGAGGA
CACGGCCTTGTATTACTGTGCAAAAGATATTTAT |

TABLE 35-continued

| SEQ ID | Description | Sequence |
|---|---|---|
| | | GGTTCGGGGAGTTCTTTTTTTGACTACTGGGGCC AGGGAATCCTGGTCACCGTCTCCTCAGccTccAccA AGGGCCCATCGGTCTTCCCCCTGGCACCCTCCTCCAAGAGCA CCTCTGGGGGCACAGCGGCCCTGGGCTGCCTGGTCAAGGACT ACTTCCCCGAACCGGTGACGGTGTCGTGGAACTCAGGCGCCC TGACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACAA GCCCAGCAACACCAAGGTGGACAAGAAAGTTGAGCCCAAAT CTTGTGACAAAACTCACACATGCCCACCGTGCCCAGCACCTG AACTCCTGGGGGGACCGTCAGTCTTCCTCTTCCCCCCAAAACC CAAGGACACCCTCATGATCTCCCGGACCCCTGAGGTCACATG CGTGGTGGTGGACGTGAGCCACGAAGACCCTGAGGTCAAGTT CAACTGGTACGTGGACGGCGTGGAGGTGCATAATGCCAAGAC AAAGCCGCGGGAGGAGCAGTACAACAGCACGTACCGTGTGG TCAGCGTCCTCACCGTCCTGCACCAGGACTGGCTGAATGGCA AGGAGTACAAGTGCAAGGTCTCCAACAAAGCCCTCCCAGCCC CCATCGAGAAAACCATCTCCAAAGCCAAAGGGCAGCCCCGA GAACCACAGGTGTACACCCTGCCCCCATCCCGGGATGAGCTG ACCAAGAACCAGGTCAGCCTGACCTGCCTGGTCAAAGGCTTC TATCCCAGCGACATCGCCGTGGAGTGGGAGAGCAATGGGCAG CCGGAGAACAACTACAAGACCACGCCTCCCGTGCTGGACTCC GACGGCTCCTTCTTCCTCTACAGCAAGCTCACCGTGGACAAG AGCAGGTGGCAGCAGGGGAACGTCTTCTCATGCTCCGTGATG CATGAGGCTCTGCACAACCACTACACGCAGAAGAGCCTCTCC CTGTCTCCGGGTAAA |
| 265 | 7A11 (full length light chain 1)-NT Seq | GACATCCAGATGACCCAGTCTCCATCCTCACTGT CTGCATCTGTAGGAGACAGAGTCACCATCACTTG TCGGGCGAGTCAGTATATTAGCAGCTGGTTAGCC TGGTATCAGCAGAAACCAGAGAAAGCCCCTAAG TCCCTGATCTATGCTGCATCCAGTTTGCAAAGTG GGGTCCCATCAAGGTTCAGCGGCAGTGGATCTG GGACAGATTTCACTCTCACCATCAGCAGCCTGCA GCCTGAAGATTTTGCAACTTATTACTGCCAACAG TATCATAGTTACCCTCCCACCTTCGGCCAAGGGA CACGACTGGAGATTAAACGAACTGTGGCTGCAC CATCTGTCTTCATCTTCCCGCCATCTGATGAGCA GTTGAAATCTGGAACTGCCTCTGTTGTGTGCCTG CTGAATAACTTCTATCCCAGAGAGGCCAAAGTAC AGTGGAAGGTGGATAACGCCCTCCAATCGGGTA ACTCCCAGGAGAGTGTCACAGAGCAGGACAGCA AGGACAGCACCTACAGCCTCAGCAGCACCCTGA CGCTGAGCAAAGCAGACTACGAGAAACACAAAG TCTACGCCTGCGAAGTCACCCATCAGGGCCTGAG CTCGCCCGTCACAAAGAGCTTCAACAGGGGAGA GTGT |
| 266 | CD73.4.IgG2C219SIgG1. 1f-Alternative NT Seq | caggtgcagc tggtggagtc tgggggaggc gtggtccagc ctgggaggtc cctgagactc tcctgtgcag cctctggatt caccttcagt aactatggca tgcactgggt ccgccaggct ccaggcaagg ggctggagtg ggtggcagtt atattgtatg atggaagtaa taaatactat ccagactccg tgaagggccg attcaccatc tccagagaca attccaagaa cacgctgtat ctgcaaatga acagcctgag agccgaggac acggctgtgt attactgtgc gagagggggc agcagctggt accctgattc ttttgatatc tggggccaag gaacaatggt caccgtctct tcagcgtcga ccaagggccc atcggtcttc cccctggcgc cctgctccag gagcacctcc gagagcacag cggccctggg ctgcctggtc aaggactact cccccgaacc ggtgacggtg tcgtggaact caggcgctct gaccagcggc gtgcacacct tcccagctgt cctacagtcc tcaggactct actccctcag cagcgtggtg accgtgccct ccagcaactt cggcacccag acctacacct gcaacgtaga tcacaagccc agcaacacca aggtggacaa gacagttgag cgcaaatcct gtgtcgagtg cccaccgtgc ccagcaccac ctgtggcagg accgtcagtc ttcctcttcc cccaaaaacc caaggacacc ctcatgatct cccggacccc tgaggtcaca tgcgtggtgg tggacgtgag ccacgaagac cctgaggtca agttcaactg gtacgtggac ggcgtggagg tgcataatgc caagacaaag |

TABLE 35-continued

| SEQ ID | Description | Sequence |
|---|---|---|
| | | ccgcgggagg agcagtacaa cagcacgtac cgtgtggtca gcgtcctcac cgtcctgcac caggactggc tgaatggcaa ggagtacaag tgcaaggtct ccaacaaagc cctcccaagc agcatcgaga aaaccatctc caaagccaaa gggcagcccc gagaaccaca ggtgtacacc ctgcccccat cccgggagga gatgaccaag aaccaggtca gcctgacctg cctggtcaaa ggcttctatc ccagcgacat cgccgtggag tgggagagca atgggcagcc ggagaacaac tacaagacca cgcctcccgt gctggactcc gacggctcct tcttcctcta tagcaagctc accgtggaca agagcaggtg gcagcagggg aacgtcttct catgctccgt gatgcatgag gctctgcaca accactacac gcagaagagc ctctccctgt ccccgggttg a |
| 267 | IgG1f | ASTKGPSVFPLAPSSKSTSGGTAALGCLVKDYFPEP VTVSWNSGALTSGVHTFPAVLQSSGLYSLSSVVTVP SSSLGTQTYICNVNHKPSNTKVDKRVEPKSCDKTHT CPPCPAPELLGGPSVFLFPPKPKDTLMISRTPEVTC VVVDVSHEDPEVKFNWYVDGVEVHNAKTKPREEQYN STYRVVSVLTVLHQDWLNGKEYKCKVSNKALPAPIE KTISKAKGQPREPQVYTLPPSREEMTKNQVSLTCLV KGFYPSDIAVEWESNGQPENNYKTTPPVLDSDGSFF LYSKLTVDKSRWQQGNVFSCSVMHEALHNHYTQKSL SLSPGK |
| 268 | IgG2.3 | ASTKGPSVFPLAPCSRSTSESTAALGCLVKDYFPEP VTVSWNSGALTSGVHTFPAVLQSSGLYSLSSVVTVP SSNFGTQTYTCNVDHKPSNTKVDKTVERKSCVECPP CPAPPVAGPSVFLFPPKPKDTLMISRTPEVTCVVVD VSHEDPEVQFNWYVDGVEVHNAKTKPREEQFNSTFR VVSVLTVVHQDWLNGKEYKCKVSNKGLPAPIEKTIS KTKGQPREPQVYTLPPSREEMTKNQVSLTCLVKGFY PSDIAVEWESNGQPENNYKTTPPMLDSDGSFFLYSK LTVDKSRWQQGNVFSCSVMHEALHNHYTQKSLSLSP GK |
| 269 | IgG2.3G1-AY | ASTKGPSVFPLAPCSRSTSESTAALGCLVKDYFPEP VTVSWNSGALTSGVHTFPAVLQSSGLYSLSSVVTVP SSNFGTQTYTCNVDHKPSNTKVDKTVERKSCVECPP CPAPELLGGPSVFLFPPKPKDTLMISRTPEVTCVVV DVSHEDPEVKFNWYVDGVEVHNAKTKPREEQYNSTY RVVSVLTVLHQDWLNGKEYKCKVSNKALPAPIEKTI SKAKGQPREPQVYTLPPSREEMTKNQVSLTCLVKGF YPSDIAVEWESNGQPENNYKTTPPVLDSDGSFFLYS KLTVDKSRWQQGNVFSCSVMHEALHNHYTQKSLSLS PGK |
| 270 | IgG2.3G1-KH | ASTKGPSVFPLAPCSRSTSESTAALGCLVKDYFPEP VTVSWNSGALTSGVHTFPAVLQSSGLYSLSSVVTVP SSNFGTQTYTCNVDHKPSNTKVDKTVERKSCVECPP CPAPPVAGPSVFLFPPKPKDTLMISRTPEVTCVVVD VSHEDPEVKFNWYVDGVEVHNAKTKPREEQYNSTYR VVSVLTVLHQDWLNGKEYKCKVSNKALPAPIEKTIS KAKGQPREPQVYTLPPSREEMTKNQVSLTCLVKGFY PSDIAVEWESNGQPENNYKTTPPVLDSDGSFFLYSK LTVDKSRWQQGNVFSCSVMHEALHNHYTQKSLSLSP GK |
| 271 | IgG2.5 | ASTKGPSVFPLAPSSRSTSESTAALGCLVKDYFPEP VTVSWNSGALTSGVHTFPAVLQSSGLYSLSSVVTVP SSNFGTQTYTCNVDHKPSNTKVDKTVERKCCVECPP CPAPPVAGPSVFLFPPKPKDTLMISRTPEVTCVVVD VSHEDPEVQFNWYVDGVEVHNAKTKPREEQFNSTFR VVSVLTVVHQDWLNGKEYKCKVSNKGLPAPIEKTIS KTKGQPREPQVYTLPPSREEMTKNQVSLTCLVKGFY PSDIAVEWESNGQPENNYKTTPPMLDSDGSFFLYSK LTVDKSRWQQGNVFSCSVMHEALHNHYTQKSLSLSP GK |
| 272 | IgG1.1f | ASTKGPSVFPLAPSSKSTSGGTAALGCLVKDYFPEP VTVSWNSGALTSGVHTFPAVLQSSGLYSLSSVVTVP SSSLGTQTYICNVNHKPSNTKVDKRVEPKSCDKTHT CPPCPAPEAEGAPSVFLFPPKPKDTLMISRTPEVTC VVVDVSHEDPEVKFNWYVDGVEVHNAKTKPREEQYN |

TABLE 35-continued

| SEQ ID Description | Sequence |
|---|---|
| | STYRVVSVLTVLHQDWLNGKEYKCKVSNKALPSSIE KTISKAKGQPREPQVYTLPPSREEMTKNQVSLTCLV KGFYPSDIAVEWESNGQPENNYKTTPPVLDSDGSFF LYSKLTVDKSRWQQGNVFSCSVMHEALHNHYTQKSL SLSPGK |
| 273 IgG2.3G1.1f-KH | ASTKGPSVFPLAPCSRSTSESTAALGCLVKDYFPEP VTVSWNSGALTSGVHTFPAVLQSSGLYSLSSVVTVP SSNFGTQTYTCNVDHKPSNTKVDKTVERKSCVECPP CPAPPVAGPSVFLFPPKPKDTLMISRTPEVTCVVVD VSHEDPEVKFNWYVDGVEVHNAKTKPREEQYNSTYR VVSVLTVLHQDWLNGKEYKCKVSNKALPSSIEKTIS KAKGQPREPQVYTLPPSREEMTKNQVSLTCLVKGFY PSDIAVEWESNGQPENNYKTTPPVLDSDGSFFLYSK LTVDKSRWQQGNVFSCSVMHEALHNHYTQKSLSLSP GK |
| 274 IgG1-deltaTHT | ASTKGPSVFPLAPSSKSTSGGTAALGCLVKDYFPEP VTVSWNSGALTSGVHTFPAVLQSSGLYSLSSVVTVP SSSLGTQTYICNVNHKPSNTKVDKRVEPKSCDKCPP CPAPELLGGPSVFLFPPKPKDTLMISRTPEVTCVVV DVSHEDPEVKFNWYVDGVEVHNAKTKPREEQYNSTY RVVSVLTVLHQDWLNGKEYKCKVSNKALPAPIEKTI SKAKGQPREPQVYTLPPSREEMTKNQVSLTCLVKGF YPSDIAVEWESNGQPENNYKTTPPVLDSDGSFFLYS KLTVDKSRWQQGNVFSCSVMHEALHNHYTQKSLSLS PGK |
| 275 IgG2.3-plusTHT | ASTKGPSVFPLAPCSRSTSESTAALGCLVKDYFPEP VTVSWNSGALTSGVHTFPAVLQSSGLYSLSSVVTVP SSNFGTQTYTCNVDHKPSNTKVDKTVERKSCVETHT CPPCPAPPVAGPSVFLFPPKPKDTLMISRTPEVTCV VVDVSHEDPEVQFNWYVDGVEVHNAKTKPREEQFNS TFRVVSVLTVVHQDWLNGKEYKCKVSNKGLPAPIEK TISKTKGQPREPQVYTLPPSREEMTKNQVSLTCLVK GFYPSDIAVEWESNGQPENNYKTTPPMLDSDGSFFL YSKLTVDKSRWQQGNVFSCSVMHEALHNHYTQKSLS LSPGK |
| 276 IgG2.3-plusGGG | ASTKGPSVFPLAPCSRSTSESTAALGCLVKDYFPEP VTVSWNSGALTSGVHTFPAVLQSSGLYSLSSVVTVP SSNFGTQTYTCNVDHKPSNTKVDKTVERKSCVEGGG CPPCPAPPVAGPSVFLFPPKPKDTLMISRTPEVTCV VVDVSHEDPEVQFNWYVDGVEVHNAKTKPREEQFNS TFRVVSVLTVVHQDWLNGKEYKCKVSNKGLPAPIEK TISKTKGQPREPQVYTLPPSREEMTKNQVSLTCLVK GFYPSDIAVEWESNGQPENNYKTTPPMLDSDGSFFL YSKLTVDKSRWQQGNVFSCSVMHEALHNHYTQKSLS LSPGK |
| 277 IgG2.5G1.1f-KH | ASTKGPSVFPLAPSSRSTSESTAALGCLVKDYFPEP VTVSWNSGALTSGVHTFPAVLQSSGLYSLSSVVTVP SSNFGTQTYTCNVDHKPSNTKVDKTVERKCCVECPP CPAPPVAGPSVFLFPPKPKDTLMISRTPEVTCVVVD VSHEDPEVKFNWYVDGVEVHNAKTKPREEQYNSTYR VVSVLTVLHQDWLNGKEYKCKVSNKALPSSIEKTIS KAKGQPREPQVYTLPPSREEMTKNQVSLTCLVKGFY PSDIAVEWESNGQPENNYKTTPPVLDSDGSFFLYSK LTVDKSRWQQGNVFSCSVMHEALHNHYTQKSLSLSP GK |
| 278 IgG2.5G1-AY | ASTKGPSVFPLAPSSRSTSESTAALGCLVKDYFPEP VTVSWNSGALTSGVHTFPAVLQSSGLYSLSSVVTVP SSNFGTQTYTCNVDHKPSNTKVDKTVERKCCVECPP CPAPELLGGPSVFLFPPKPKDTLMISRTPEVTCVVV DVSHEDPEVKFNWYVDGVEVHNAKTKPREEQYNSTY RVVSVLTVLHQDWLNGKEYKCKVSNKALPAPIEKTI SKAKGQPREPQVYTLPPSREEMTKNQVSLTCLVKGF YPSDIAVEWESNGQPENNYKTTPPVLDSDGSFFLYS KLTVDKSRWQQGNVFSCSVMHEALHNHYTQKSLSLS PGK |
| 279 IgG2.5G1-KH | ASTKGPSVFPLAPSSRSTSESTAALGCLVKDYFPEP VTVSWNSGALTSGVHTFPAVLQSSGLYSLSSVVTVP SSNFGTQTYTCNVDHKPSNTKVDKTVERKCCVECPP CPAPPVAGPSVFLFPPKPKDTLMISRTPEVTCVVVD VSHEDPEVKFNWYVDGVEVHNAKTKPREEQYNSTYR |

TABLE 35-continued

| SEQ ID | Description | Sequence |
|---|---|---|
| | | VVSVLTVLHQDWLNGKEYKCKVSNKALPAPIEKTIS KAKGQPREPQVYTLPPSREEMTKNQVSLTCLVKGFY PSDIAVEWESNGQPENNYKTTPPVLDSDGSFFLYSK LTVDKSRWQQGNVFSCSVMHEALHNHYTQKSLSLSP GK |
| 280 | IgG2.5-plusTHT | ASTKGPSVFPLAPSSRSTSESTAALGCLVKDYFPEP VTVSWNSGALTSGVHTFPAVLQSSGLYSLSSVVTVP SSNFGTQTYTCNVDHKPSNTKVDKTVERKCCVETHT CPPCPAPPVAGPSVFLFPPKPKDTLMISRTPEVTCV VVDVSHEDPEVQFNWYVDGVEVHNAKTKPREEQFNS TFRVVSVLTVVHQDWLNGKEYKCKVSNKGLPAPIEK TISKTKGQPREPQVYTLPPSREEMTKNQVSLTCLVK GFYPSDIAVEWESNGQPENNYKTTPPMLDSDGSFFL YSKLTVDKSRWQQGNVFSCSVMHEALHNHYTQKSLS LSPGK |
| 281 | IgG1-G2.3G1-AY | ASTKGPSVFPLAPSSKSTSGGTAALGCLVKDYFPEP VTVSWNSGALTSGVHTFPAVLQSSGLYSLSSVVTVP SSSLGTQTYICNVNHKPSNTKVDKRVERKSCVECPP CPAPELLGGPSVFLFPPKPKDTLMISRTPEVTCVVV DVSHEDPEVKFNWYVDGVEVHNAKTKPREEQYNSTY RVVSVLTVLHQDWLNGKEYKCKVSNKALPAPIEKTI SKAKGQPREPQVYTLPPSREEMTKNQVSLTCLVKGF YPSDIAVEWESNGQPENNYKTTPPVLDSDGSFFLYS KLTVDKSRWQQGNVFSCSVMHEALHNHYTQKSLSLS PGK |
| 282 | IgG1-G2.3G1-KH | ASTKGPSVFPLAPSSKSTSGGTAALGCLVKDYFPEP VTVSWNSGALTSGVHTFPAVLQSSGLYSLSSVVTVP SSSLGTQTYICNVNHKPSNTKVDKRVERKSCVECPP CPAPPVAGPSVFLFPPKPKDTLMISRTPEVTCVVVD VSHEDPEVKFNWYVDGVEVHNAKTKPREEQYNSTYR VVSVLTVLHQDWLNGKEYKCKVSNKALPAPIEKTIS KAKGQPREPQVYTLPPSREEMTKNQVSLTCLVKGFY PSDIAVEWESNGQPENNYKTTPPVLDSDGSFFLYSK LTVDKSRWQQGNVFSCSVMHEALHNHYTQKSLSLSP GK |
| 283 | CD73 from FIG. 27A | XCPRAARAPATLLLALGAVLWPAAGAWELTILHTND VHSRLEQTSEDSSKCVNASRCMGGVARLFTKVQQIR RAEPNVLLLDAGDQYQGTIWFTVYKGAEVAHFMNAL RYDAMALGNHEFDNGVEGLIEPLLKEAKFPILSANI KAKGPLASQISGLYLPYKVLPVGDEVVGIVGYTSKE TPFLSNPGTNLVFEDEITALQPEVDKLKTLNVNKII ALGHSGFEMDKLIAQKVRGVDVVVGGHSNTFLYTGN PPSKEVPAGKYPFIVTSDDGRKVPVVQAYAFGKYLG YLKIEFDERGNVISSHGNPILLNSSIPEDPSIKADI NKWRIKLDNYSTQELGKTIVYLDGSSQSCRFRECNM GNLICDAMINNNLRHADETFWNHVSMCILNGGGIRS PIDERNNGTITWENLAAVLPFGGTFDLVQLKGSTLK KAFEHSVHRYGQSTGEFLQVGGIHVVYDLSRKPGDR VVKLDVLCTKCRVPSYDPLKMDEVYKVILPNFLANG GDGFQMIKDELLRHDSGDQDINVVSTYISKMKVIYP AVEGRIKHHHHHH |
| 284 | Hinge region amino acid | VDKRV |
| 285 | Hinge region amino acid | VDKTV |
| 286 | Hinge region amino acid | EPKSCDKTHT |
| 287 | Hinge region amino acid | ELKTPLGDTTHT |
| 288 | Hinge region amino acid | EPKS |
| 289 | Hinge region amino acid | ESKYGPP |
| 290 | Hinge region amino acid | CPRCP |
| 291 | Hinge region amino acid | CCVECPPCP |
| 292 | Hinge region amino acid | CPRCP (EPKSCDTPPPCPRCP)$_3$ |
| 293 | Hinge region amino acid | CPRCP (EPKSCDTPPPCPRCP)$_2$ |
| 294 | Hinge region amino acid | CPRCP (EPKSCDTPPPCPRCP)$_1$ |

TABLE 35-continued

| SEQ ID | Description | Sequence |
|---|---|---|
| 295 | Hinge region amino acid | CDTPPPCPRCP (EPKSCDTPPPCPRCP)$_2$ |
| 296 | Hinge region amino acid | CDTPPPCPRCP |
| 297 | Hinge region amino acid | CPSCP |
| 298 | Hinge region amino acid | APELLGG |
| 299 | Hinge region amino acid | APPVAG |
| 300 | G2-G1-G1-G1 | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 301 | G2.5-G1-G1-G1 | ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 302 | G1-G2.3-G2-G2 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| 303 | G1-KRGEGSSNLF | ASTKGPSVFPLAPSSRSTSESTAALGCLVKDYFPEPVTVSWNSGALTSGVHTFPAVLQSSGLYSLSSVVTVPSSNFGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 304 | G1-KRGEGS | ASTKGPSVFPLAPSSRSTSESTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 305 | G1-SNLF | ASTKGPSVFPLAPSSKSTSGGTAALGCLVKDYFPEPVTVSWNSGALTSGVHTFPAVLQSSGLYSLSSVVTVPSSNFGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| SEQ ID | Description | Sequence |
|---|---|---|
| 306 | IgG1-ITNDRTPR | ASTKGPSVFPLAPSSKSTSGGTAALGCLVKDYFPE PVTVSWNSGALTSGVHTFPAVLQSSGLYSLSSVVT VPSSSLGTQTYTCNVDHKPSNTKVDKTVERKSCDK THTCPPCPAPELLGGPSVFLFPPKPKDTLMISRTP EVTCVVVDVSHEDPEVKFNWYVDGVEVHNAKTKPR EEQYNSTYRVVSVLTVLHQDWLNGKEYKCKVSNKA LPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEAL HNHYTQKSLSLSPGK |
| 307 | G1-SNLFPR | ASTKGPSVFPLAPSSKSTSGGTAALGCLVKDYFPE PVTVSWNSGALTSGVHTFPAVLQSSGLYSLSSVVT VPSSNFGTQTYICNVNHKPSNTKVDKRVERKSCDK THTCPPCPAPELLGGPSVFLFPPKPKDTLMISRTP EVTCVVVDVSHEDPEVKFNWYVDGVEVHNAKTKPR EEQYNSTYRVVSVLTVLHQDWLNGKEYKCKVSNKA LPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEAL HNHYTQKSLSLSPG |
| 308 | G2-RKEGSGNSFL | ASTKGPSVFPLAPCSKSTSGGTAALGCLVKDYFPE PVTVSWNSGALTSGVHTFPAVLQSSGLYSLSSVVT VPSSSLGTQTYTCNVDHKPSNTKVDKTVERKSCVE CPPCPAPPVAGPSVFLFPPKPKDTLMISRTPEVTC VVVDVSHEDPEVQFNWYVDGVEVHNAKTKPREEQF NSTFRVVSVLTVVHQDWLNGKEYKCKVSNKGLPAP IEKTISKTKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 309 | G2-RKEGSG | ASTKGPSVFPLAPCSKSTSGGTAALGCLVKDYFPE PVTVSWNSGALTSGVHTFPAVLQSSGLYSLSSVVT VPSSNFGTQTYTCNVDHKPSNTKVDKTVERKSCVE CPPCPAPPVAGPSVFLFPPKPKDTLMISRTPEVTC VVVDVSHEDPEVQFNWYVDGVEVHNAKTKPREEQF NSTFRVVSVLTVVHQDWLNGKEYKCKVSNKGLPAP IEKTISKTKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 310 | G2-NSFL | ASTKGPSVFPLAPCSRSTSESTAALGCLVKDYFPE PVTVSWNSGALTSGVHTFPAVLQSSGLYSLSSVVT VPSSSLGTQTYTCNVDHKPSNTKVDKTVERKSCVE CPPCPAPPVAGPSVFLFPPKPKDTLMISRTPEVTC VVVDVSHEDPEVQFNWYVDGVEVHNAKTKPREEQF NSTFRVVSVLTVVHQDWLNGKEYKCKVSNKGLPAP IEKTISKTKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 311 | IgG2-TIDNTRRP | ASTKGPSVFPLAPCSRSTSESTAALGCLVKDYFPE PVTVSWNSGALTSGVHTFPAVLQSSGLYSLSSVVT VPSSNFGTQTYICNVNHKPSNTKVDKRVEPKSCVE CPPCPAPPVAGPSVFLFPPKPKDTLMISRTPEVTC VVVDVSHEDPEVQFNWYVDGVEVHNAKTKPREEQF NSTFRVVSVLTVVHQDWLNGKEYKCKVSNKGLPAP IEKTISKTKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 312 | G2-NSFLRP | ASTKGPSVFPLAPCSRSTSESTAALGCLVKDYFPE PVTVSWNSGALTSGVHTFPAVLQSSGLYSLSSVVT VPSSSLGTQTYTCNVDHKPSNTKVDKTVEPKSCVE CPPCPAPPVAGPSVFLFPPKPKDTLMISRTPEVTC VVVDVSHEDPEVQFNWYVDGVEVHNAKTKPREEQF NSTFRVVSVLTVVHQDWLNGKEYKCKVSNKGLPAP IEKTISKTKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |

TABLE 35-continued

| SEQ ID | Description | Sequence |
|---|---|---|
| 313 | G1-G1-G2-G1-AY | ASTKGPSVFPLAPSSKSTSGGTAALGCLVKDYFPE PVTVSWNSGALTSGVHTFPAVLQSSGLYSLSSVVT VPSSSLGTQTYICNVNHKPSNTKVDKRVEPKSCDK THTCPPCPAPELLGGPSVFLFPPKPKDTLMISRTP EVTCVVVDVSHEDPEVQFNWYVDGVEVHNAKTKPR EEQFNSTFRVVSVLTVVHQDWLNGKEYKCKVSNKG LPAPIEKTISKTKGQPREPQVYTLPPSREEMTKNQ VSLTCLVKGFYPSDIAVEWESNGQPENNYKTTPPV LDSDGSFFLYSKLTVDKSRWQQGNVFSCSVMHEAL HNHYTQKSLSLSPGK |
| 314 | G1-G1-G2-G1-KH | ASTKGPSVFPLAPSSKSTSGGTAALGCLVKDYFPE PVTVSWNSGALTSGVHTFPAVLQSSGLYSLSSVVT VPSSSLGTQTYICNVNHKPSNTKVDKRVEPKSCDK THTCPPCPAPPVAGPSVFLFPPKPKDTLMISRTPE VTCVVVDVSHEDPEVQFNWYVDGVEVHNAKTKPRE EQFNSTFRVVSVLTVVHQDWLNGKEYKCKVSNKGL PAPIEKTISKTKGQPREPQVYTLPPSREEMTKNQV SLTCLVKGFYPSDIAVEWESNGQPENNYKTTPPVL DSDGSFFLYSKLTVDKSRWQQGNVFSCSVMHEALH NHYTQKSLSLSPGK |
| 315 | G2-G2.3-G1-G2-KH | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKSCVE CPPCPAPPVAGPSVFLFPPKPKDTLMISRTPEVTC VVVDVSHEDPEVKFNWYVDGVEVHNAKTKPREEQY NSTYRVVSVLTVLHQDWLNGKEYKCKVSNKALPAP IEKTISKAKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 316 | G2.5-G2.3-G1-G2-KH | ASTKGPSVFPLAPSSRSTSESTAALGCLVKDYFPE PVTVSWNSGALTSGVHTFPAVLQSSGLYSLSSVVT VPSSNFGTQTYTCNVDHKPSNTKVDKTVERKSCVE CPPCPAPPVAGPSVFLFPPKPKDTLMISRTPEVTC VVVDVSHEDPEVKFNWYVDGVEVHNAKTKPREEQY NSTYRVVSVLTVLHQDWLNGKEYKCKVSNKALPAP IEKTISKAKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 317 | G2-G2.3-G1-G2-AY | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKSCVE CPPCPAPELLGGPSVFLFPPKPKDTLMISRTPEVT CVVVDVSHEDPEVKFNWYVDGVEVHNAKTKPREEQ YNSTYRVVSVLTVLHQDWLNGKEYKCKVSNKALPA PIEKTISKAKGQPREPQVYTLPPSREEMTKNQVSL TCLVKGFYPSDIAVEWESNGQPENNYKTTPPMLDS DGSFFLYSKLTVDKSRWQQGNVFSCSVMHEALHNH YTQKSLSLSPG |
| 318 | G2.5-G2.3-G1-G2-AY | ASTKGPSVFPLAPSSRSTSESTAALGCLVKDYFPE PVTVSWNSGALTSGVHTFPAVLQSSGLYSLSSVVT VPSSNFGTQTYTCNVDHKPSNTKVDKTVERKSCVE CPPCPAPELLGGPSVFLFPPKPKDTLMISRTPEVT CVVVDVSHEDPEVKFNWYVDGVEVHNAKTKPREEQ YNSTYRVVSVLTVLHQDWLNGKEYKCKVSNKALPA PIEKTISKAKGQPREPQVYTLPPSREEMTKNQVSL TCLVKGFYPSDIAVEWESNGQPENNYKTTPPMLDS DGSFFLYSKLTVDKSRWQQGNVFSCSVMHEALHNH YTQKSLSLSPGK |
| 319 | G1-G2.3-G1-G1-KH | ASTKGPSVFPLAPSSKSTSGGTAALGCLVKDYFPE PVTVSWNSGALTSGVHTFPAVLQSSGLYSLSSVVT VPSSSLGTQTYICNVNHKPSNTKVDKRVEPKSCVE CPPCPAPPVAGPSVFLFPPKPKDTLMISRTPEVTC VVVDVSHEDPEVKFNWYVDGVEVHNAKTKPREEQY NSTYRVVSVLTVLHQDWLNGKEYKCKVSNKALPAP IEKTISKAKGQPREPQVYTLPPSREEMTKNQVSLT CLVKGFYPSDIAVEWESNGQPENNYKTTPPVLDSD GSFFLYSKLTVDKSRWQQGNVFSCSVMHEALHNHY TQKSLSLSPGK |

TABLE 35-continued

| SEQ ID Description | Sequence |
|---|---|
| 320 G2-G1-G2-G2-AY | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKSCDK THTCPPCPAPELLGGPSVFLFPPKPKDTLMISRTP EVTCVVVDVSHEDPEVQFNWYVDGVEVHNAKTKPR EEQFNSTFRVVSVLTVVHQDWLNGKEYKCKVSNKG LPAPIEKTISKTKGQPREPQVYTLPPSREEMTKNQ VSLTCLVKGFYPSDIAVEWESNGQPENNYKTTPPM LDSDGSFFLYSKLTVDKSRWQQGNVFSCSVMHEAL HNHYTQKSLSLSPGK |
| 321 G2.5-G1-G2-G2-AY | ASTKGPSVFPLAPSSRSTSESTAALGCLVKDYFPE PVTVSWNSGALTSGVHTFPAVLQSSGLYSLSSVVT VPSSNFGTQTYTCNVDHKPSNTKVDKTVERKSCDK THTCPPCPAPELLGGPSVFLFPPKPKDTLMISRTP EVTCVVVDVSHEDPEVQFNWYVDGVEVHNAKTKPR EEQFNSTFRVVSVLTVVHQDWLNGKEYKCKVSNKG LPAPIEKTISKTKGQPREPQVYTLPPSREEMTKNQ VSLTCLVKGFYPSDIAVEWESNGQPENNYKTTPPM LDSDGSFFLYSKLTVDKSRWQQGNVFSCSVMHEAL HNHYTQKSLSLSPGK |
| 322 G1-G2-G1-G1-AY | ASTKGPSVFPLAPSSKSTSGGTAALGCLVKDYFPE PVTVSWNSGALTSGVHTFPAVLQSSGLYSLSSVVT VPSSSLGTQTYICNVNHKPSNTKVDKRVEPKSCVE CPPCPAPELLGGPSVFLFPPKPKDTLMISRTPEVT CVVVDVSHEDPEVKFNWYVDGVEVHNAKTKPREEQ YNSTYRVVSVLTVLHQDWLNGKEYKCKVSNKALPA PIEKTISKAKGQPREPQVYTLPPSREEMTKNQVSL TCLVKGFYPSDIAVEWESNGQPENNYKTTPPVLDS DGSFFLYSKLTVDKSRWQQGNVFSCSVMHEALHNH YTQKSLSLSPGK |
| 323 G2-G1-G2-G2-KH | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKSCDK THTCPPCPAPPVAGPSVFLFPPKPKDTLMISRTPE VTCVVVDVSHEDPEVQFNWYVDGVEVHNAKTKPRE EQFNSTFRVVSVLTVVHQDWLNGKEYKCKVSNKGL PAPIEKTISKTKGQPREPQVYTLPPSREEMTKNQV SLTCLVKGFYPSDIAVEWESNGQPENNYKTTPPML DSDGSFFLYSKLTVDKSRWQQGNVFSCSVMHEALH NHYTQKSLSLSPG |
| 324 G2.5-G1-G2-G2-KH | ASTKGPSVFPLAPSSRSTSESTAALGCLVKDYFPE PVTVSWNSGALTSGVHTFPAVLQSSGLYSLSSVVT VPSSNFGTQTYTCNVDHKPSNTKVDKTVERKSCDK THTCPPCPAPPVAGPSVFLFPPKPKDTLMISRTPE VTCVVVDVSHEDPEVQFNWYVDGVEVHNAKTKPRE EQFNSTFRVVSVLTVVHQDWLNGKEYKCKVSNKGL PAPIEKTISKTKGQPREPQVYTLPPSREEMTKNQV SLTCLVKGFYPSDIAVEWESNGQPENNYKTTPPML DSDGSFFLYSKLTVDKSRWQQGNVFSCSVMHEALH NHYTQKSLSLSPGK |
| 325 IgG1-deltaHinge | ASTKGPSVFPLAPSSKSTSGGTAALGCLVKDYFPE PVTVSWNSGALTSGVHTFPAVLQSSGLYSLSSVVT VPSSSLGTQTYICNVNHKPSNTKVDKRVEPKCPPC PAPELLGGPSVFLFPPKPKDTLMISRTPEVTCVVV DVSHEDPEVKFNWYVDGVEVHNAKTKPREEQYNST YRVVSVLTVLHQDWLNGKEYKCKVSNKALPAPIEK TISKAKGQPREPQVYTLPPSREEMTKNQVSLTCLV KGFYPSDIAVEWESNGQPENNYKTTPPVLDSDGSF FLYSKLTVDKSRWQQGNVFSCSVMHEALHNHYTQK SLSLSPGK |
| 326 IgG2-deltaHinge | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKCPPC PAPPVAGPSVFLFPPKPKDTLMISRTPEVTCVVVD VSHEDPEVQFNWYVDGVEVHNAKTKPREEQFNSTF RVVSVLTVVHQDWLNGKEYKCKVSNKGLPAPIEKT ISKTKGQPREPQVYTLPPSREEMTKNQVSLTCLVK GFYPSDIAVEWESNGQPENNYKTTPPMLDSDGSFF LYSKLTVDKSRWQQGNVFSCSVMHEALHNHYTQKS LSLSPGK |

TABLE 35-continued

| SEQ ID Description | Sequence |
|---|---|
| 327 IgG2.5-deltaHinge | ASTKGPSVFPLAPSSRSTSESTAALGCLVKDYFPE PVTVSWNSGALTSGVHTFPAVLQSSGLYSLSSVVT VPSSNFGTQTYTCNVDHKPSNTKVDKTVERKCPPC PAPPVAGPSVFLFPPKPKDTLMISRTPEVTCVVVD VSHEDPEVQFNWYVDGVEVHNAKTKPREEQFNSTF RVVSVLTVVHQDWLNGKEYKCKVSNKGLPAPIEKT ISKTKGQPREPQVYTLPPSREEMTKNQVSLTCLVK GFYPSDIAVEWESNGQPENNYKTTPPMLDSDGSFF LYSKLTVDKSRWQQGNVFSCSVMHEALHNHYTQKS LSLSPGK |
| 328 IgG1-deltaG237 | ASTKGPSVFPLAPSSKSTSGGTAALGCLVKDYFPE PVTVSWNSGALTSGVHTFPAVLQSSGLYSLSSVVT VPSSSLGTQTYICNVNHKPSNTKVDKRVEPKSCDK THTCPPCPAPELLGPSVFLFPPKPKDTLMISRTPE VTCVVVDVSHEDPEVKFNWYVDGVEVHNAKTKPRE EQYNSTYRVVSVLTVLHQDWLNGKEYKCKVSNKAL PAPIEKTISKAKGQPREPQVYTLPPSREEMTKNQV SLTCLVKGFYPSDIAVEWESNGQPENNYKTTPPVL DSDGSFFLYSKLTVDKSRWQQGNVFSCSVMHEALH NHYTQKSLSLSPG |
| 329 IgG2-plusG237 | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKSCVE CPPCPAPPVAGGPSVFLFPPKPKDTLMISRTPEVT CVVVDVSHEDPEVQFNWYVDGVEVHNAKTKPREEQ FNSTFRVVSVLTVVHQDWLNGKEYKCKVSNKGLPA PIEKTISKTKGQPREPQVYTLPPSREEMTKNQVSL TCLVKGFYPSDIAVEWESNGQPENNYKTTPPMLDS DGSFFLYSKLTVDKSRWQQGNVFSCSVMHEALHNH YTQKSLSLSPGK |
| 330 IgG2.4 | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKCSVE CPPCPAPPVAGPSVFLFPPKPKDTLMISRTPEVTC VVVDVSHEDPEVQFNWYVDGVEVHNAKTKPREEQF NSTFRVVSVLTVVHQDWLNGKEYKCKVSNKGLPAP IEKTISKTKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 331 IgG2.3/4 | ASTKGPSVFPLAPCSRSTSESTAALGCLVKDYFPE PVTVSWNSGALTSGVHTFPAVLQSSGLYSLSSVVT VPSSNFGTQTYTCNVDHKPSNTKVDKTVERKSSVE CPPCPAPPVAGPSVFLFPPKPKDTLMISRTPEVTC VVVDVSHEDPEVQFNWYVDGVEVHNAKTKPREEQF NSTFRVVSVLTVVHQDWLNGKEYKCKVSNKGLPAP IEKTISKTKGQPREPQVYTLPPSREEMTKNQVSLT CLVKGFYPSDIAVEWESNGQPENNYKTTPPMLDSD GSFFLYSKLTVDKSRWQQGNVFSCSVMHEALHNHY TQKSLSLSPGK |
| 332 IgG2.3-V13 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPPV AGDSVFLEPPKPKDTLMISRTPEVTCVVVDVSHEDPEV QFNWYVDGVEVHNAKTKPREEQFNSTFRVVSVLTVVHQ DWLNGKEYKCKVSNKGLPAPIEKTISKTKGQPREPQVY TLPPSREEMTKNQVSLTCLVKGFYPSDIAVEWESNGQP ENNYKTTPPMLDSDGSFFLYSKLTVDKSRWQQGNVFSC SVMHEALHNHYTQKSLSLSPGK |
| 333 IgG2.3-V14 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPPV AGDSVFLEPPKPKDTLMISRTPEVTCVVVDVSHEDGEV QFNWYVDGVEVHNAKTKPREEQFNSTFRVVSVLTVVHQ DWLNGKEYKCKVSNKGLPAPIEKTISKTKGQPREPQVY TLPPSREEMTKNQVSLTCLVKGFYPSDIAVEWESNGQP ENNYKTTPPMLDSDGSFFLYSKLTVDKSRWQQGNVFSC SVMHEALHNHYTQKSLSLSPGK |
| 334 IgG2.3-V15 | ASTKGPSVFPLAPCSRSTSESTAALGCLVKDYFPEPVT VSWNSGALTSGVHTFPAVLQSSGLYSLSSVVTVPSSNF |

TABLE 35-continued

| SEQ ID | Description | Sequence |
|---|---|---|
| | | GTQTYTCNVDHKPSNTKVDKTVERKSCVECPPCPAPPV AGDSVFLEPPKPKDTLMISRTPEVTCVVVDVSDEDG**EV QFNWYVDGVEVHNAKTKPREEQFNSTFRVVSVLTVVHQ DWLNGKEYKCKVSNKGLPAPIEKTISKTKGQPREPQVY TLPPSREEMTKNQVSLTCLVKGFYPSDIAVEWESNGQP ENNYKTTPPMLDSDGSFFLYSKLTVDKSRWQQGNVFSC SVMHEALHNHYTQKSLSLSPGK |
| 335 | IgG2.3-V16 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPPV AGDSVFLEPPKPKDTLMISRTPEVTCVVVDVSHEDGEV QFNWYVDGVEVHNAKTKPREEQFNSTFRVVSVLTVVHQ DWLNGKEYKCKVSNKGLPRPIEKTISKTKGQPREPQVY TLPPSREEMTKNQVSLTCLVKGFYPSDIAVEWESNGQP ENNYKTTPPMLDSDGSFFLYSKLTVDKSRWQQGNVFSC SVMHEALHNHYTQKSLSLSPGK |
| 336 | IgG2.3-V17 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPPV AGDSVFLEPPKPKDTLMISRTPEVTCVVVDVSDEDGEV QFNWYVDGVEVHNAKTKPREEQFNSTFRVVSVLTVVHQ DWLNGKEYKCKVSNKGLPRP**IEKTISKTKGQPREPQVY TLPPSREEMTKNQVSLTCLVKGFYPSDIAVEWESNGQP ENNYKTTPPMLDSDGSFFLYSKLTVDKSRWQQGNVFSC SVMHEALHNHYTQKSLSLSPGK |
| 337 | IgG2.3-V18 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPPV AGPSVFLEPPKPKDTLMISRTPEVTCVVVDVEHEDPEV QFNWYVDGVEVHNAKTKPREEQFNSTFRVVSVLTVVHQ DWLNGKEYKCKVSNKGLPAPIEKTISKTKGQPREPQVY TLPPSREEMTKNQVSLTCLVKGFYPSDIAVEWESNGQP ENNYKTTPPMLDSDGSFFLYSKLTVDKSRWQQGNVFSC SVMHEALHNHYTQKSLSLSPGK |
| 338 | IgG2.3-V19 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPPV AGPSVFLEPPKPKDTLMISRTPEVTCVVVDVEHEDPEV QFNWYVDGVEVHNAKTKPREEQFNSTFRVVSVLTVVHQ DWLNGKEYKCKVSNKGFPAPIEKTISKTKGQPREPQVY TLPPSREEMTKNQVSLTCLVKGFYPSDIAVEWESNGQP ENNYKTTPPMLDSDGSFFLYSKLTVDKSRWQQGNVFSC SVMHEALHNHYTQKSLSLSPGK |
| 339 | IgG2.3G1-AY-V20 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPELL GGDSVFLEPPKPKDTLMISRTPEVTCVVVDVSHEDPE VKFNWYVDGVEVHNAKTKPREEQYNSTYRVVSVLTVLH QDWLNGKEYKCKVSNKALPAPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 340 | IgG2.3G1-AY-V21 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPELL GGDSVFLEPPKPKDTLMISRTPEVTCVVVDVSHEDGE VKFNWYVDGVEVHNAKTKPREEQYNSTYRVVSVLTVLH QDWLNGKEYKCKVSNKALPAPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 341 | IgG2.3G1-AY-V22 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPELL GGDSVFLEPPKPKDTLMISRTPEVTCVVVDVSDEDGE VKFNWYVDGVEVHNAKTKPREEQYNSTYRVVSVLTVLH QDWLNGKEYKCKVSNKALPAPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |

TABLE 35-continued

| SEQ ID | Description | Sequence |
|---|---|---|
| 342 | IgG2.3G1-AY-V23 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPEL LGGDSVFLEPPKPKDTLMISRTPEVTCVVVDVSHEDGE VKFNWYVDGVEVHNAKTKPREEQYNSTYRVVSVLTVLH QDWLNGKEYKCKVSNKALPRPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 343 | IgG2.3G1-AY-V24 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPEL LGGDSVFLEPPKPKDTLMISRTPEVTCVVVDVSDEDGE VKFNWYVDGVEVHNAKTKPREEQYNSTYRVVSVLTVLH QDWLNGKEYKCKVSNKALPRPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 344 | IgG2.3G1-AY-V25 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPEL LGDDSVFLEPPKPKDTLMISRTPEVTCVVVDVSDEDGE VKFNWYVDGVEVHNAKTKPREEQYNSTYRVVSVLTVLH QDWLNGKEYKCKVSNKALPRPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 345 | IgG2.3G1-AY-V26 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPDL LGDDSVFLEPPKPKDTLMISRTPEVTCVVVDVSDEDGE VKFNWYVDGVEVHNAKTKPREEQYNSTYRVVSVLTVLH QDWLNGKEYKCKVSNKALPRPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 346 | IgG2.3G1-AY-V27 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPEL LGGPSVFLEPPKPKDTLMISRTPEVTCVVVDVEHEDPE VKFNWYVDGVEVHNAKTKPREEQYNSTYRVVSVLTVLH QDWLNGKEYKCKVSNKALPAPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 347 | IgG2.3G1-AY-V28 | ASTKGPSVFPLAPCSRSTSESTAALGCLVKDYFPEPVT VSWNSGALTSGVHTFPAVLQSSGLYSLSSVVTVPSSNF GTQTYTCNVDHKPSNTKVDKTVERKSCVECPPCPAPEL LGGPSVFLEPPKPKDTLMISRTPEVTCVVVDVEHEDPE VKFNWYVDGVEVHNAKTKPREEQYNSTYRVVSVLTVLH QDWLNGKEYKCKVSNKAFPAPIEKTISKAKGQPREPQV YTLPPSREEMTKNQVSLTCLVKGFYPSDIAVEWESNGQ PENNYKTTPPVLDSDGSFFLYSKLTVDKSRWQQGNVFS CSVMHEALHNHYTQKSLSLSPGK |
| 348 | Alternative hinge | ERKCCVECPPCPAPPVAG |
| 349 | Alternative hinge | ERKSCVECPPCPAPPVAG |
| 350 | Alternative hinge | ERKCSVECPPCPAPPVAG |
| 351 | Alternative hinge | ERKXCVECPPCPAPPVAG |
| 352 | Alternative hinge | ERKCXVECPPCPAPPVAG |
| 353 | Alternative hinge | ERKCCVECPPCPAPPVAGX |
| 354 | Alternative hinge | ERKSCVECPPCPAPPVAGX |

TABLE 35-continued

| SEQ ID | Description | Sequence |
|---|---|---|
| 355 | Alternative hinge | ERKCSVECPPCPAPPVAGX |
| 356 | Alternative hinge | ERKXCVECPPCPAPPVAGX |
| 357 | Alternative hinge | ERKCXVECPPCPAPPVAGX |
| 358 | Alternative hinge | ERKCCVECPPCPAPELLGG |
| 359 | Alternative hinge | ERKSCVECPPCPAPELLGG |
| 360 | Alternative hinge | ERKCCSVECPPCPAPELLGG |
| 361 | Alternative hinge | ERKXCVECPPCPAPELLGG |
| 362 | Alternative hinge | ERKCXVECPPCPAPELLGG |
| 363 | Alternative hinge | ERKCCVECPPCPAPELLG |
| 364 | Alternative hinge | ERKSCVECPPCPAPELLG |
| 365 | Alternative hinge | ERKCCSVECPPCPAPELLG |
| 366 | Alternative hinge | ERKXCVECPPCPAPELLG |
| 367 | Alternative hinge | ERKCXVECPPCPAPELLG |
| 368 | Alternative hinge | ERKCCVECPPCPAP |
| 369 | Alternative hinge | ERKSCVECPPCPAP |
| 370 | Alternative hinge | ERKCSVECPPCPAP |
| 371 | Alternative hinge | ERKXCVECPPCPAP |
| 372 | Alternative hinge | ERKCXVECPPCPAP |
| 373 | Portion of hinge | PVAG |
| 374 | Portion of hinge | ELLG |
| 375 | Portion of hinge | ELLGG |
| 376 | Portion of hinge | SCDKTHT |
| 377 | Portion of hinge | CCVE |
| 378 | wt IgG2 CH1 domain | ASTKGPSVFPLAPCSRSTSESTAALGCLVKDYFPEPVTVSWNSGALTSGVHTFPAVLQSSGLYSLSSVVTVPSS*NF*GTQTYTCNVDHKPSNTKVDKTV |
| 379 | IgG2 CH1 and hinge | ASTKGPSVFPLAPCSRSTSESTAALGCLVKDYFPEPVTVSWNSGALTSGVHTFPAVLQSSGLYSLSSVVTVPSS*NF*GTQTYTCNVDHKPSNTKVDKTV<u>ERKCCVECPPCPAPPVAG</u> |
| 380 | Portion of hinge | CPPCPAP |

The Sequence Listing provides the sequences of the mature variable regions and heavy and light chains (i.e., sequences do not include signal peptides).

Equivalents

Those skilled in the art will recognize, or be able to ascertain using no more than routine experimentation, many equivalents of the specific embodiments disclosed herein. Such equivalents are intended to be encompassed by the following claims.

SEQUENCE LISTING (380 sequences)

SEQ ID NO: 1 - protein, 574 aa, Homo sapiens
  misc_feature (1)..(574): Human CD73 isoform 1
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 2 - protein, 524 aa, Homo sapiens
  misc_feature (1)..(524): Human CD73 isoform 2
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 3 - protein, 574 aa, Macaca fascicularis
  misc_feature (1)..(574): Cynomolgus CD73
MCPRAARAPATLLLAVGALLWSAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFETDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHADEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEIYKVILPNFLANGGDGFQMIKDELLRHDSGDQDINVVSTYISKMKVIYPAVEGRIKFSTGSHCHGSFSLIFLSFCAVIFVLYQ

SEQ ID NO: 4 - protein, 121 aa, Artificial Sequence
  Synthetic:  11F11 VH
QVQLVESGGGVVQPGRSLRLSCATSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS

SEQ ID NO: 5 - protein, 5 aa, Artificial Sequence
  Synthetic:  11F11 VH CDR1
NYGMH

SEQ ID NO: 6 - protein, 17 aa, Artificial Sequence
  Synthetic:  11F11 VH CDR2
VILYDGSNKYYPDSVKG

SEQ ID NO: 7 - protein, 12 aa, Artificial Sequence
  Synthetic:  11F11 VH CDR3
GGSSWYPDSFDI

SEQ ID NO: 8 - protein, 107 aa, Artificial Sequence
  Synthetic:  11F11 VK1
EIVLTQSPATLSLSPGERATLSCRASQGVSSYLAWYQQKPGQAPRLLIYDASNRATGIPARFSGSGPGTDFTLTISSLEPEDFAVYYCQQRSNWHLTFGGGTKVEIK

SEQ ID NO: 9 - protein, 11 aa, Artificial Sequence
  Synthetic:  11F11 VK1 CDR1
RASQGVSSYLA

SEQ ID NO: 10 - protein, 7 aa, Artificial Sequence
  Synthetic:  11F11 VK1 CDR2
DASNRAT

SEQ ID NO: 11 - protein, 9 aa, Artificial Sequence
  Synthetic:  11F11 VK1 CDR3
QQRSNWHLT

SEQ ID NO: 12 - protein, 107 aa, Artificial Sequence
  Synthetic:  11F11 VK2
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 13 - protein, 11 aa, Artificial Sequence
  Synthetic:  11F11 VK2 CDR1
RASQGISSWLA

SEQ ID NO: 14 - protein, 7 aa, Artificial Sequence
  Synthetic:  11F11 VK2 CDR2
AASSLQS

SEQ ID NO: 15 - protein, 9 aa, Artificial Sequence
  Synthetic:  11F11 VK2 CDR3
QQYNSYPLT

SEQ ID NO: 16 - protein, 120 aa, Artificial Sequence
  Synthetic:  4C3 VH
EVQLVESGGGLVQPGRSLRLSCAASGFTFDDYAMHWVRQAPGKGLEWVSGISWKSGSIGYADSVKGRFTISRDNAKNSLYLQMNSLRAEDTALYYCVKGYYVILTGLDYWGQGTLVTVSS

SEQ ID NO: 17 - protein, 5 aa, Artificial Sequence
  Synthetic:  4C3 VH CDR1
DYAMH

SEQ ID NO: 18 - protein, 17 aa, Artificial Sequence
  Synthetic:  4C3 VH CDR2
GISWKSGSIGYADSVKG

SEQ ID NO: 19 - protein, 11 aa, Artificial Sequence
  Synthetic:  4C3 VH CDR3
GYYVILTGLDY

SEQ ID NO: 20 - protein, 107 aa, Artificial Sequence
  Synthetic:  4C3 VK1
EIVLTQSPGTLSLSPGERATLSCRASQSVSSYLAWYQQKPGQAPRLLIYGASSRATGIPDRFSGSGSGTDFTLTISRLEPEDFAVYYCQQYGSSPLTFGGGTKVEIK

SEQ ID NO: 21 - protein, 12 aa, Artificial Sequence
  Synthetic:  4C3 VK1 CDR1
RASQSVSSYLAW

SEQ ID NO: 22 - protein, 7 aa, Artificial Sequence
  Synthetic:  4C3 VK1 CDR2
ASSRATG

SEQ ID NO: 23 - protein, 8 aa, Artificial Sequence
  Synthetic:  4C3 VK1 CDR3
QYGSSPLT

SEQ ID NO: 24 - protein, 107 aa, Artificial Sequence
  Synthetic:  4C3 VK2
DIQMTQSPSSLSASVGDRVTFTCRASQGISSWLAWYQQKPEKAPKSLIYAASSLQSGVPSRFSGSGSGTDFTLTISSLQPEDFATYYCQQYNSYPPTFGQGTKVEIK

SEQ ID NO: 25 - protein, 11 aa, Artificial Sequence
  Synthetic:  4C3 VK2 CDR1
RASQGISSWLA

SEQ ID NO: 26 - protein, 7 aa, Artificial Sequence
  Synthetic:  4C3 VK2 CDR2
AASSLQS

SEQ ID NO: 27 - protein, 9 aa, Artificial Sequence
  Synthetic:  4C3 VK2 CDR3
QQYNSYPPT

SEQ ID NO: 28 - protein, 107 aa, Artificial Sequence; identical to SEQ ID NO: 24
  Synthetic:  4C3 VK3

SEQ ID NO: 29 - protein, 11 aa, Artificial Sequence
  Synthetic:  4C3 VK3 CDR1
RASQGISSWLA

SEQ ID NO: 30 - protein, 7 aa, Artificial Sequence
  Synthetic:  4C3 VK3 CDR2
AASSLQS

SEQ ID NO: 31 - protein, 9 aa, Artificial Sequence
  Synthetic:  4C3 VK3 CDR3
QQYNSYPPT

SEQ ID NO: 32 - protein, 122 aa, Artificial Sequence
  Synthetic:  4D4 VH
QVQLVESGGGVVQPGRSLRLSCAASGFTFSNYGMHWVRQAPGKGLEWVAVIWYDESNKYYADSVKGRFTISRDNSKNTLFLQMNSLRAEDTAVYYCARGYNSRWYPDAFDIWGQGTMVTVSS

SEQ ID NO: 33 - protein, 5 aa, Artificial Sequence
  Synthetic:  4D4 VH CDR1
NYGMH

SEQ ID NO: 34 - protein, 17 aa, Artificial Sequence
  Synthetic:  4D4 VH CDR2
VIWYDESNKYYADSVKG

SEQ ID NO: 35 - protein, 13 aa, Artificial Sequence
  Synthetic:  4D4 VH CDR3
GYNSRWYPDAFDI

SEQ ID NO: 36 - protein, 107 aa, Artificial Sequence; identical to SEQ ID NO: 12
  Synthetic:  4D4 VK1

SEQ ID NO: 37 - protein, 11 aa, Artificial Sequence
  Synthetic:  4D4 VK1 CDR1
RASQGISSWLA

SEQ ID NO: 38 - protein, 7 aa, Artificial Sequence
  Synthetic:  4D4 VK1 CDR2
AASSLQS

SEQ ID NO: 39 - protein, 9 aa, Artificial Sequence
  Synthetic:  4D4 VK1 CDR3
QQYNSYPLT

SEQ ID NO: 40 - protein, 121 aa, Artificial Sequence
  Synthetic:  10D2 VH1
QVQLVESGGGVVQPGRSLRLSCAASGFTFSNYGLHWVRQAPGKGLEWVAVIRYDGSNKYYADSVKGRFTISRDNSKNTLYLQMSSLRAEDTAVYYCARGGSSWYPDGLDVWGQGTTVTVSS

SEQ ID NO: 41 - protein, 5 aa, Artificial Sequence
  Synthetic:  10D2 VH1 CDR1
NYGLH

SEQ ID NO: 42 - protein, 17 aa, Artificial Sequence
  Synthetic:  10D2 VH1 CDR2
VIRYDGSNKYYADSVKG

SEQ ID NO: 43 - protein, 12 aa, Artificial Sequence
  Synthetic:  10D2 VH1 CDR3
GGSSWYPDGLDV

SEQ ID NO: 44 - protein, 106 aa, Artificial Sequence
  Synthetic:  10D2 VK1
AIQLTQSPSSLSASVGDRVTITCRASQGISSALAWYQQKPGKAPKLLIYDASSLESGVPSRFSGSGSGTDFTLTISSLQPEDFATYYCQQFNSYPTFGGGTKVEIK

SEQ ID NO: 45 - protein, 11 aa, Artificial Sequence
  Synthetic:  10D2 VK1 CDR1
RASQGISSALA

SEQ ID NO: 46 - protein, 7 aa, Artificial Sequence
  Synthetic:  10D2 VK1 CDR2
DASSLES

SEQ ID NO: 47 - protein, 8 aa, Artificial Sequence
  Synthetic:  10D2 VK1 CDR3
QQFNSYPT

SEQ ID NO: 48 - protein, 107 aa, Artificial Sequence; identical to SEQ ID NO: 12
  Synthetic:  10D2 VK2

SEQ ID NO: 49 - protein, 11 aa, Artificial Sequence
  Synthetic:  10D2 VK2 CDR1
RASQGISSWLA

SEQ ID NO: 50 - protein, 7 aa, Artificial Sequence
  Synthetic:  10D2 VK2 CDR2
AASSLQS

SEQ ID NO: 51 - protein, 9 aa, Artificial Sequence
  Synthetic:  10D2 VK2 CDR3
QQYNSYPLT

SEQ ID NO: 52 - protein, 120 aa, Artificial Sequence
  Synthetic:  11A6 VH
EVQLVESGGNLVQPGRSLRLSCAASGFTFDDYAMHWVRQAPGKGLEWVSGISWNNNDIGYADSVKGRFIISRDNAKNSLYLQMNSLRPEDTALYYCVKGYYVILTGLDYWGQGTPVTVSS

SEQ ID NO: 53 - protein, 5 aa, Artificial Sequence
  Synthetic:  11A6 VH CDR1
DYAMH

SEQ ID NO: 54 - protein, 17 aa, Artificial Sequence
  Synthetic:  11A6 VH CDR2
GISWNNNDIGYADSVKG

SEQ ID NO: 55 - protein, 11 aa, Artificial Sequence
  Synthetic:  11A6 VH CDR3
GYYVILTGLDY

SEQ ID NO: 56 - protein, 107 aa, Artificial Sequence; identical to SEQ ID NO: 12
  Synthetic:  11A6 VK1

SEQ ID NO: 57 - protein, 11 aa, Artificial Sequence
  Synthetic:  11A6 VK1 CDR1
RASQGISSWLA

SEQ ID NO: 58 - protein, 7 aa, Artificial Sequence
  Synthetic:  11A6 VK1 CDR2
AASSLQS

SEQ ID NO: 59 - protein, 9 aa, Artificial Sequence
  Synthetic:  11A6 VK1 CDR3
QQYNSYPLT

SEQ ID NO: 60 - protein, 121 aa, Artificial Sequence
  Synthetic:  24H2 VH
QVQLVESGGGVVQPGRSLRLSCAASGFTFSNYGMHWVRQAPGKGLEWVAVIWYDGGNKYYADSVKGRFTISRDNSKNTLFLQMNSLRAEDTAVYYCARGGSSWYPDAFDIWGQGTMVTVSS

SEQ ID NO: 61 - protein, 5 aa, Artificial Sequence
  Synthetic:  24H2 VH CDR1
NYGMH

SEQ ID NO: 62 - protein, 17 aa, Artificial Sequence
  Synthetic:  24H2 VH CDR2
VIWYDGGNKYYADSVKG

SEQ ID NO: 63 - protein, 12 aa, Artificial Sequence
  Synthetic:  24H2 VH CDR3
GGSSWYPDAFDI

SEQ ID NO: 64 - protein, 107 aa, Artificial Sequence; identical to SEQ ID NO: 12
  Synthetic:  24H2 VK1

SEQ ID NO: 65 - protein, 11 aa, Artificial Sequence
  Synthetic:  24H2 VK1 CDR1
RASQGISSWLA

SEQ ID NO: 66 - protein, 7 aa, Artificial Sequence
  Synthetic:  24H2 VK1 CDR2
AASSLQS

SEQ ID NO: 67 - protein, 9 aa, Artificial Sequence
  Synthetic:  24H2 VK1 CDR3
QQYNSYPLT

SEQ ID NO: 68 - protein, 119 aa, Artificial Sequence
  Synthetic:  5F8 VH
EVQLVESGGGLVQPGGSLRLSCAASGFTFSSYWMHWVRQAPGKGLVWVSRIISDGSSTGYADSVKGRFTISRDNAKNTLYLQMNSLRAEDTAVYYCAREFSSGWYFDYWGQGTLVTVSS

SEQ ID NO: 69 - protein, 5 aa, Artificial Sequence
  Synthetic:  5F8 VH CDR1
SYWMH

SEQ ID NO: 70 - protein, 17 aa, Artificial Sequence
  Synthetic:  5F8 VH CDR2
RIISDGSSTGYADSVKG

SEQ ID NO: 71 - protein, 10 aa, Artificial Sequence
  Synthetic:  5F8 VH CDR3
EFSSGWYFDY

SEQ ID NO: 72 - protein, 107 aa, Artificial Sequence
  Synthetic:  5F8 VK1
AIQLTQSPSSLSASVGDRVTITCRASQGISSALAWYQQKPGKAPKLLIYDASSLESGVPSRFSGSGSGTDFTLTISSLQPEDFATYYCQQFSSYPRTFGQGTKVEIK

SEQ ID NO: 73 - protein, 11 aa, Artificial Sequence
  Synthetic:  5F8 VK1 CDR1
RASQGISSALA

SEQ ID NO: 74 - protein, 7 aa, Artificial Sequence
  Synthetic:  5F8 VK1 CDR2
DASSLES

SEQ ID NO: 75 - protein, 9 aa, Artificial Sequence
  Synthetic:  5F8 VK1 CDR3
QQFSSYPRT

SEQ ID NO: 76 - protein, 107 aa, Artificial Sequence
  Synthetic:  5F8 VK2
DIQMTQSPSSLSASVGDRVTITCRASQGISSWLAWYQQKPEKAPKSLIYAASSLQSGVPSRFSGSGSGTGFTLTISSLQPEDFATYYCQQYNSYPRTFGQGTKVEIK

SEQ ID NO: 77 - protein, 11 aa, Artificial Sequence
  Synthetic:  5F8 VK2 CDR1
RASQGISSWLA

SEQ ID NO: 78 - protein, 7 aa, Artificial Sequence
  Synthetic:  5F8 VK2 CDR2
AASSLQS

SEQ ID NO: 79 - protein, 9 aa, Artificial Sequence
  Synthetic:  5F8 VK2 CDR3
QQYNSYPRT

SEQ ID NO: 80 - protein, 121 aa, Artificial Sequence
  Synthetic:  6E11 VH
EVQLVESGGALVQPGRSLRLSCAASGFTFDDYAMHWVRQAPGKGLEWVSGITWNSGGIGYADSVKGRFTISRDNAKNSLYLQMNSLRAEDTALYYCAKDRYYSSWLLFDNWGQGILVTVSS

SEQ ID NO: 81 - protein, 5 aa, Artificial Sequence
  Synthetic:  6E11 VH CDR1
DYAMH

SEQ ID NO: 82 - protein, 17 aa, Artificial Sequence
  Synthetic:  6E11 VH CDR2
GITWNSGGIGYADSVKG

SEQ ID NO: 83 - protein, 12 aa, Artificial Sequence
  Synthetic:  6E11 VH CDR3
DRYYSSWLLFDN

SEQ ID NO: 84 - protein, 107 aa, Artificial Sequence
  Synthetic:  6E11 VK1
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSFTFGPGTKVDIK

SEQ ID NO: 85 - protein, 12 aa, Artificial Sequence
  Synthetic:  6E11 VK1 CDR1
RASQSVSSSYLA

SEQ ID NO: 86 - protein, 7 aa, Artificial Sequence
  Synthetic:  6E11 VK1 CDR2
GASSRAT

SEQ ID NO: 87 - protein, 8 aa, Artificial Sequence
  Synthetic:  6E11 VK1 CDR3
QHYGSSFT

SEQ ID NO: 88 - protein, 121 aa, Artificial Sequence
  Synthetic:  7A11 VH
EVQLVESGGGLVQTGRSLRLSCAASGFTFDDYAMHWVRQAPGKGLEWVSDISWNSDIIGYADSVKGRFTISRDNAKNSLYLQMNSLRAEDTALYYCAKDIYGSGSSFFDYWGQGILVTVSS

SEQ ID NO: 89 - protein, 5 aa, Artificial Sequence
  Synthetic:  7A11 VH CDR1
DYAMH

SEQ ID NO: 90 - protein, 17 aa, Artificial Sequence
  Synthetic:  7A11 VH CDR2
DISWNSDIIGYADSVKG

SEQ ID NO: 91 - protein, 12 aa, Artificial Sequence
  Synthetic:  7A11 VH CDR3
DIYGSGSSFFDY

SEQ ID NO: 92 - protein, 107 aa, Artificial Sequence
  Synthetic:  7A11 VK1
DIQMTQSPSSLSASVGDRVTITCRASQYISSWLAWYQQKPEKAPKSLIYAASSLQSGVPSRFSGSGSGTDFTLTISSLQPEDFATYYCQQYHSYPPTFGQGTRLEIK

SEQ ID NO: 93 - protein, 11 aa, Artificial Sequence
  Synthetic:  7A11 VK1 CDR1
RASQYISSWLA

SEQ ID NO: 94 - protein, 7 aa, Artificial Sequence
  Synthetic:  7A11 VK1 CDR2
AASSLQS

SEQ ID NO: 95 - protein, 9 aa, Artificial Sequence
  Synthetic:  7A11 VK1 CDR3
QQYHSYPPT

SEQ ID NO: 96 - protein, 19 aa, Artificial Sequence
  Synthetic:  11F11 epitope #1
FTKVQQIRRAEPNVLLLDA

SEQ ID NO: 97 - protein, 16 aa, Artificial Sequence
  Synthetic:  11F11 epitope #2
LYLPYKVLPVGDEVVG

SEQ ID NO: 98 - protein, 98 aa, Homo sapiens
  misc_feature (1)..(98): Wildtype IgG1 CH1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 99 - protein, 553 aa, Artificial Sequence
  Synthetic:  His-tagged CD73
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHADETFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKHHHHHH

SEQ ID NO: 100 - protein, 447 aa, Artificial Sequence
  Synthetic:  11F11 (full length heavy chain)
QVQLVESGGGVVQPGRSLRLSCATSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 101 - protein, 214 aa, Artificial Sequence
  Synthetic:  11F11 (full length light chain 1)
EIVLTQSPATLSLSPGERATLSCRASQGVSSYLAWYQQKPGQAPRLLIYDASNRATGIPARFSGSGPGTDFTLTISSLEPEDFAVYYCQQRSNWHLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 214 aa, Artificial Sequence
  Synthetic:  11F11 (full length light chain 2)
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 450 aa, Artificial Sequence
  Synthetic:  4C3 (full length heavy chain)
EVQLVESGGGLVQPGRSLRLSCAASGFTFDDYAMHWVRQAPGKGLEWVSGISWKSGSIGYADSVKGRFTISRDNAKNSLYLQMNSLRAEDTALYYCVKGYYVILTGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 214 aa, Artificial Sequence
  Synthetic:  4C3 (full length light chain 1)
EIVLTQSPGTLSLSPGERATLSCRASQSVSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 214 aa, Artificial Sequence
  Synthetic:  4C3 (full length light chain 2)
DIQMTQSPSSLSASVGDRVTFTCRASQGISSWLAWYQQKPEKAPKSLIYAASSLQSGVPSRFSGSGSGTDFTLTISSLQPEDFATYYCQQYNSYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 214 aa, Artificial Sequence; identical to SEQ ID NO: 105
  Synthetic:  4C3 (full length light chain 3)

SEQ ID NO: 107 - protein, 448 aa, Artificial Sequence
  Synthetic:  4D4 (full length heavy chain)
QVQLVESGGGVVQPGRSLRLSCAASGFTFSNYGMHWVRQAPGKGLEWVAVIWYDESNKYYADSVKGRFTISRDNSKNTLFLQMNSLRAEDTAVYYCARGYNSRWYPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 108 - protein, 214 aa, Artificial Sequence; identical to SEQ ID NO: 102
  Synthetic:  4D4 (full length light chain 1)

SEQ ID NO: 109 - protein, 448 aa, Artificial Sequence
  Synthetic:  10D2 (full length heavy chain)
QVQLVESGGGVVQPGRSLRLSCAASGFTFSNYGLHWVRQAPGKGLEWVAVIRYDGSNKYYADSVKGRFTISRDNSKNTLYLQMSSLRAEDTAVYYCARGGSSWYPDGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 110 - protein, 213 aa, Artificial Sequence
  Synthetic:  10D2 (full length light chain 1)
AIQLTQSPSSLSASVGDRVTITCRASQGISSALAWYQQKPGKAPKLLIYDASSLESGVPSRFSGSGSGTDFTLTISSLQPEDFATYYCQQFNSYPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 214 aa, Artificial Sequence; identical to SEQ ID NO: 102
  Synthetic:  10D2 (full length light chain 2)

SEQ ID NO: 112 - protein, 450 aa, Artificial Sequence
  Synthetic:  11A6 (full length heavy chain)
EVQLVESGGNLVQPGRSLRLSCAASGFTFDDYAMHWVRQAPGKGLEWVSGISWNNNDIGYADSVKGRFIISRDNAKNSLYLQMNSLRPEDTALYYCVKGYYVILTGLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 214 aa, Artificial Sequence; identical to SEQ ID NO: 102
  Synthetic:  11A6 (full length light chain 1)

SEQ ID NO: 114 - protein, 448 aa, Artificial Sequence
  Synthetic:  24H2 (full length heavy chain)
QVQLVESGGGVVQPGRSLRLSCAASGFTFSNYGMHWVRQAPGKGLEWVAVIWYDGGNKYYADSVKGRFTISRDNSKNTLFLQMNSLRAEDTAVYYCARGGSSWYPDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 115 - protein, 214 aa, Artificial Sequence; identical to SEQ ID NO: 102
  Synthetic:  24H2 (full length light chain 1)

SEQ ID NO: 116 - protein, 449 aa, Artificial Sequence
  Synthetic:  5F8 (full length heavy chain)
EVQLVESGGGLVQPGGSLRLSCAASGFTFSSYWMHWVRQAPGKGLVWVSRIISDGSSTGYADSVKGRFTISRDNAKNTLYLQMNSLRAEDTAVYYCAREFSSGWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 214 aa, Artificial Sequence
  Synthetic:  5F8 (full length light chain 1)
AIQLTQSPSSLSASVGDRVTITCRASQGISSALAWYQQKPGKAPKLLIYDASSLESGVPSRFSGSGSGTDFTLTISSLQPEDFATYYCQQFSSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 118 - protein, 214 aa, Artificial Sequence
  Synthetic:  5F8 (full length light chain 2)
DIQMTQSPSSLSASVGDRVTITCRASQGISSWLAWYQQKPEKAPKSLIYAASSLQSGVPSRFSGSGSGTGFTLTISSLQPEDFATYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 119 - protein, 451 aa, Artificial Sequence
  Synthetic:  6E11 (full length heavy chain)
EVQLVESGGALVQPGRSLRLSCAASGFTFDDYAMHWVRQAPGKGLEWVSGITWNSGGIGYADSVKGRFTISRDNAKNSLYLQMNSLRAEDTALYYCAKDRYYSSWLLFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 214 aa, Artificial Sequence
  Synthetic:  6E11 (full length light chain 1)
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 121 - protein, 451 aa, Artificial Sequence
  Synthetic:  7A11 (full length heavy chain)
EVQLVESGGGLVQTGRSLRLSCAASGFTFDDYAMHWVRQAPGKGLEWVSDISWNSDIIGYADSVKGRFTISRDNAKNSLYLQMNSLRAEDTALYYCAKDIYGSGSSFFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 214 aa, Artificial Sequence
  Synthetic:  7A11 (full length light chain 1)
DIQMTQSPSSLSASVGDRVTITCRASQYISSWLAWYQQKPEKAPKSLIYAASSLQSGVPSRFSGSGSGTDFTLTISSLQPEDFATYYCQQYHSYPPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 123 - protein, 18 aa, Artificial Sequence
  Synthetic:  Hinge C219S
ERKSCVECPPCPAPPVAG

SEQ ID NO: 124 - protein, 98 aa, Homo sapiens
  misc_feature (1)..(98): IgG2 CH1 (wildtype)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 125 - protein, 103 aa, Artificial Sequence
  Synthetic:  IgG1 CH2 + A330S and P331S
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAK

SEQ ID NO: 126 - protein, 330 aa, Homo sapiens [sequence omitted]

SEQ ID NO: 127 - protein, 330 aa, Homo sapiens
  misc_feature (1)..(330): Human IgG1 constant region (allotype variant)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 107 aa, Artificial Sequence
  Synthetic:  IgG1 CH3 + E356 and M358
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 330 aa, Artificial Sequence [sequence omitted]

SEQ ID NO: 130 - protein, 326 aa, Artificial Sequence
  Synthetic:  IgG2 constant region
ASTKGPSVFPLAPCSRSTSESTAALGCLVKDYFPEPVTVSWNSGALTSGVHTFPAVLQSSGLYSLSSWTVPSSNFGTQTYTCNVDHKPSNTKVDKTVERKCCVECPPCPAPPPVAGPSVFLFPPKPKDTLMISRTPEVTCVVVDVSHEDPEVQFNWYVDGVEVHNAKTKPREEQFNSTYRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGDFFLYSKLTVDKSRWQQGNVFSCSVMHEALHNHYTQKSLSLSPGK

SEQ ID NO: 131 - protein, 107 aa, Homo sapiens [sequence omitted]

SEQ ID NO: 132 - protein, 5 aa, Artificial Sequence
  Synthetic:  Heavy chain C-terminus
LSPGK

SEQ ID NO: 133 - protein, 447 aa, Artificial Sequence
  Synthetic:  CD73.4-IgG2CS-IgG1.1f, AA sequence
QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - DNA, 1341 bp, Artificial Sequence
  Synthetic:  CD73.4-IgG2CS-IgG1.1f, NT sequence
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 135 - protein, 121 aa, Artificial Sequence
  Synthetic:  CD73.4 VH (a.a.)
QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS

SEQ ID NO: 136 - protein, 18 aa, Homo sapiens
  misc_feature (1)..(18): Wildtype IgG2 hinge
ERKCCVECPPCPAPPVAG

SEQ ID NO: 137 - protein, 103 aa, Homo sapiens
  misc_feature (1)..(103): Wildtype IgG1 CH2
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 138 - protein, 107 aa, Homo sapiens; identical to SEQ ID NO: 128
  misc_feature (1)..(107): Wildtype IgG1 CH3

SEQ ID NO: 139 - DNA, 363 bp, Artificial Sequence
  Synthetic:  11F11 VH - Nucleotide Sequence
caggtgcagctggtggagtctgggggaggcgtggtccagcctgggaggtccctgagactctcctgtgcaacgtctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttca

SEQ ID NO: 140 - DNA, 321 bp, Artificial Sequence
  Synthetic:  11F11 VK1 - Nucleotide Sequence
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcatctcactttcggcggagggaccaaggtggagatcaaa

SEQ ID NO: 141 - DNA, 321 bp, Artificial Sequence
  Synthetic:  11F11 VK2 - Nucleotide Sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctctcactttcggcggagggaccaaggtggagatcaaa

SEQ ID NO: 142 - DNA, 360 bp, Artificial Sequence
  Synthetic:  4C3 VH - Nucleotide Sequence
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaagagtggtagcataggctatgcggactctgtgaagggccgattcaccatctccagagacaacgccaagaactccctgtatctgcaaatgaacagtctgagagctgaggacacggccttgtattactgtgtaaaagggtattacgttattttgactggccttgactactggggccagggaaccctggtcaccgtctcctca

SEQ ID NO: 143 - DNA, 321 bp, Artificial Sequence
  Synthetic:  4C3 VK1 - Nucleotide Sequence
gaaattgtgttgacgcagtctccaggcaccctgtctttgtctccaggggaaagagccaccctctcctgcagggccagtcagagtgttagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaa

SEQ ID NO: 144 - DNA, 321 bp, Artificial Sequence
  Synthetic:  4C3 VK2 - Nucleotide Sequence
gacatccagatgacccagtctccatcctcactgtctgcatctgtaggagacagagtcaccttcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccaacgttcggccaggggaccaaggtggaaatcaaa

SEQ ID NO: 145 - DNA, 321 bp, Artificial Sequence
  Synthetic:  4C3 VK3 - Nucleotide Sequence
gacatccagatgacccagtctccatcctcactgtctgcatctgtaggagacagagtcaccttcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccaacgttcggccaagggaccaaggtggaaatcaaa

SEQ ID NO: 146 - DNA, 366 bp, Artificial Sequence
  Synthetic:  4D4 VH - Nucleotide Sequence
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaagtaataaatactatgcagactccgtgaagggccgattcaccatctccagagacaattccaagaacacgctgtttctgcaaatgaacagcctgagagccgaggacacggctgtgtattattgtgcgagagggtataacagcaggtggtaccctgatgcttttgatatctggggccaagggacaatggtcaccgtctcttca

SEQ ID NO: 147 - DNA, 321 bp, Artificial Sequence
  Synthetic:  4D4 VK1 - Nucleotide Sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttacccgctcactttcggcggagggaccaaggtggagatcaaa

SEQ ID NO: 148 - DNA, 363 bp, Artificial Sequence
  Synthetic:  10D2 VH1 - Nucleotide Sequence
caggtgcagctggtggagtctgggggaggcgtggtccagcctgggaggtccctgagactctcctgtgcagcgtctggattcaccttcagtaactatggcctgcactgggtccgccaggctccaggcaaggggctggagtgggtggcagttatacggtatgatggaagtaataaatactatgcagactccgtgaagggccgattcaccatctccagagacaattccaagaacacgctgtatctgcaaatgagcagcctgagagccgaggacacggctgtgtattactgtgcgagggggggcagcagctggtacccggacggtttggacgtctggggccaagggaccacggtcaccgtctcctca

SEQ ID NO: 149 - DNA, 318 bp, Artificial Sequence
  Synthetic:  10D2 VK1 - Nucleotide Sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccccactttcggcggagggaccaaggtggagatcaaa

SEQ ID NO: 150 - DNA, 321 bp, Artificial Sequence; identical to SEQ ID NO: 147
  Synthetic:  10D2 VK2 - Nucleotide Sequence

SEQ ID NO: 151 - DNA, 360 bp, Artificial Sequence
  Synthetic:  11A6 VH - Nucleotide Sequence
gaagtgcagctggtggaatctgggggaaacttggtacagcctggcaggtccctgagactctcctgtgcagcctctggattcacctttgatgattatgccatgcactgggtccggcaagctccagggaagggcctggagtgggtctcaggtattagttggaataataatgacataggctatgcggactctgtgaagggccgattcatcatctccagagacaacgccaagaactccctgtatctgcaaatgaacagtctgagacctgaggacacggccttgtattattgtgtaaaaggttattacgttattttgactggtcttgactactggggccagggaaccccggtcaccgtctcctca

SEQ ID NO: 152 - DNA, 321 bp, Artificial Sequence; identical to SEQ ID NO: 147
  Synthetic:  11A6 VK1 - Nucleotide Sequence

SEQ ID NO: 153 - DNA, 363 bp, Artificial Sequence
  Synthetic:  24H2 VH - Nucleotide Sequence
caggtgcaactggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatggaggtaataaatactatgcagactccgtgaagggccgattcaccatctccagagacaattccaagaacacgctgtttctgcaaatgaacagcctgagagccgaagacacggctgtgtattactgtgcgagagggggcagcagctggtaccctgatgcttttgatatctggggccaagggacaatggtcaccgtctcttca

SEQ ID NO: 154 - DNA, 321 bp, Artificial Sequence; identical to SEQ ID NO: 141
  Synthetic:  24H2 VK1 - Nucleotide Sequence

SEQ ID NO: 155 - DNA, 357 bp, Artificial Sequence
  Synthetic:  5F8 VH - Nucleotide Sequence
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattattagtgatgggagtagcacaggttacgcggattccgtgaagggccgattcaccatctccagagacaacgccaagaacacgctgtatctgcaaatgaacagtctgagagccgaggacacggctgtgtattactgtgcaagagagtttagcagtggctggtactttgactactggggccagggaaccctggtcaccgtctcctca

SEQ ID NO: 156 - DNA, 321 bp, Artificial Sequence
  Synthetic:  5F8 VK1 - Nucleotide Sequence
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttagtagttaccctcggacgttcggccaagggaccaaggtggaaatcaaa

SEQ ID NO: 157 - DNA, 321 bp, Artificial Sequence
  Synthetic:  5F8 VK2 - Nucleotide Sequence
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacaggtttcactctcaccatcagcagcctgcagcctgaagattttgcaacttattactgccaacagtataatagttaccctcggacgttcggccaagggaccaaggtggaaatcaaa

SEQ ID NO: 158 - DNA, 363 bp, Artificial Sequence
  Synthetic:  6E11 VH - Nucleotide Sequence
gaagtgcagctggtggagtctgggggagccttggtacagcctggcaggtccctgagactctcctgtgcagcctctggattcacctttgatgattatgccatgcactgggtccggcaagctccagggaagggcctggagtgggtctcaggtattacttggaatagtggtggcataggctacgcggactctgtgaagggccgattcaccatctccagagacaacgccaagaactccctgtatctgcaaatgaacagtctgagagctgaggacacggccttgtattactgtgcaaaagataggtattacagcagttggctcctctttgacaactggggccagggaattctggtcaccgtctcctca

SEQ ID NO: 159 - DNA, 321 bp, Artificial Sequence
  Synthetic:  6E11 VK1 - Nucleotide Sequence
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcattatggtagctcattcactttcggccctgggaccaaagtggatatcaaa

SEQ ID NO: 160 - DNA, 363 bp, Artificial Sequence
  Synthetic:  7A11 VH - Nucleotide Sequence
gaagtgcagctggtggagtctgggggaggcttggtacagactggcaggtccctgagactctcctgtgcagcctctggattcacctttgatgattatgccatgcactgggtccggcaagctccagggaagggcctggagtgggtctcagatattagttggaatagtgatattataggctatgcggactctgtgaagggccgattcaccatctctagagacaacgccaagaactccctgtatctgcaaatgaacagtctgagagctgaggacacggccttgtattactgtgcaaaagatatttatggttcggggagttctttttttgactactggggccagggaatcctggtcaccgtctcctca

SEQ ID NO: 161 - DNA, 321 bp, Artificial Sequence
  Synthetic:  7A11 VK1 - Nucleotide Sequence
gacatccagatgacccagtctccatcctcactgtctgcatctgtaggagacagagtcaccatcacttgtcgggcgagtcagtatattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtatcatagttaccctcccaccttcggccaagggacacgactggagattaaa

SEQ ID NO: 162 - protein, 326 aa, Artificial Sequence
  Synthetic:  IgG1-IgG2-IgG1f2 (MHCCR)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 326 aa, Artificial Sequence
  Synthetic:  IgG1-IgG2CS-IgG1f2 (MHCCR)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 326 aa, Artificial Sequence
  Synthetic:  IgG2-IgG1f2 (MHCCR)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 326 aa, Artificial Sequence
  Synthetic:  IgG2CS-IgG1f2 (MHCCR)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 166 - protein, 326 aa, Artificial Sequence
  Synthetic:  IgG1-IgG2-IgG1.1f (MHCCR)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 326 aa, Artificial Sequence
  Synthetic:  IgG1-IgG2CS-IgG1.1f (MHCCR)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 326 aa, Artificial Sequence
  Synthetic:  IgG2-IgG1.1f (MHCCR)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 326 aa, Artificial Sequence
  Synthetic:  IgG2CS-IgG1.1f (MHCCR)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 120 aa, Artificial Sequence
  Synthetic:  CD73.3 VH (a.a)
EVQLVESGGGLVQPGRSLRLSCAASGFTFDDYAMHWVRQAPGKGLEWVSGISWKSGSIGYADSVKGRFTISRDNAKNSLYLQMNSLRAEDTVLYYCVKGYYVILTGLDYWGQGTLVTVSS

SEQ ID NO: 171 - protein, 121 aa, Artificial Sequence
  Synthetic:  CD73.5 VH (a.a)
QVQLVESGGGVVQPGRSLRLSCASSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS

SEQ ID NO: 172 - protein, 121 aa, Artificial Sequence
  Synthetic:  CD73.6 VH (a.a)
QVQLVESGGGVVQPGRSLRLSCAASGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSS

SEQ ID NO: 173 - protein, 121 aa, Artificial Sequence
  Synthetic:  CD73.7 VH (a.a)
QVQLVESGGGVVQPGRSLRLSCASSGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSS

SEQ ID NO: 174 - protein, 121 aa, Artificial Sequence
  Synthetic:  CD73.8 VH (a.a)
QVQLVESGGGVVQPGRSLRLSCAASGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSS

SEQ ID NO: 175 - protein, 121 aa, Artificial Sequence
  Synthetic:  CD73.9 VH (a.a)
QVQLVESGGGVVQPGRSLRLSCASSGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSS

SEQ ID NO: 176 - protein, 121 aa, Artificial Sequence
  Synthetic:  CD73.10 VH (a.a)
QVQLVESGGGVVQPGRSLRLSCAASGFTFSNYGMHWVRQAPGKGLEWVAVIWYDESNKYYPDSVKGRFTISRDNSKNTLYLQMNSLRAEDTAVYYCARGGSSWYPDSFDIWGQGTMVTVSS

SEQ ID NO: 177 - protein, 122 aa, Artificial Sequence; identical to SEQ ID NO: 32
  Synthetic:  CD73.11 VH (a.a)

SEQ ID NO: 178 - protein, 19 aa, Artificial Sequence
  Synthetic:  IgG2/IgG1 hybrid hinge
ERKCCVECPPCPAPELLGG

SEQ ID NO: 179 - protein, 19 aa, Artificial Sequence
  Synthetic:  IgG2 C219S/IgG1 hybrid hinge
ERKSCVECPPCPAPELLGG

SEQ ID NO: 180 - protein, 327 aa, Artificial Sequence
  Synthetic:  IgG1-IgG2-IgG1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 326 aa, Artificial Sequence; identical to SEQ ID NO: 163
  Synthetic:  IgG1-IgG2CS-IgG1f

SEQ ID NO: 182 - protein, 327 aa, Artificial Sequence
  Synthetic:  IgG2-IgG1f
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 326 aa, Artificial Sequence; identical to SEQ ID NO: 165
  Synthetic:  IgG2CS-IgG1f

SEQ ID NO: 184 - protein, 449 aa, Artificial Sequence
  Synthetic:  mAb-CD73.3-Vh-hHC-IgG1.1f
EVQLVESGGGLVQPGRSLRLSCAASGFTFDDYAMHWVRQAPGKGLEWVSGISWKSGSIGYADSVKGRFTISRDNAKNSLYLQMNSLRAEDTALYYCAKGYYVILTGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 185 - protein, 445 aa, Artificial Sequence
  Synthetic:  mAb-CD73.3-Vh-hHC-IgG2-C219S
EVQLVESGGGLVQPGRSLRLSCAASGFTFDDYAMHWVRQAPGKGLEWVSGISWKSGSIGYADSVKGRFTISRDNAKNSLYLQMNSLRAEDTALYYCAKGYYVILTGLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 186 - protein, 445 aa, Artificial Sequence
  Synthetic:  mAb-CD73.3-Vh-hHC-IgG2-C219S-IgG1.1f
EVQLVESGGGLVQPGRSLRLSCAASGFTFDDYAMHWVRQAPGKGLEWVSGISWKSGSIGYADSVKGRFTISRDNAKNSLYLQMNSLRAEDTALYYCAKGYYVILTGLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 187 - protein, 450 aa, Artificial Sequence
  Synthetic:  mAb-CD73.4-Vh-hHC-IgG1.1f
QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 188 - protein, 446 aa, Artificial Sequence
  Synthetic:  mAb-CD73.4-Vh-hHC-IgG2-C219S
QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 189 - protein, 446 aa, Artificial Sequence
  Synthetic:  mAb-CD73.4-Vh-hHC-IgG2-C219S-IgG1.1f (identical to SEQ ID NO: 133, except lacks C-terminal lysine)
QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 190 - protein, 450 aa, Artificial Sequence
  Synthetic:  mAb-CD73.5-Vh-hHC-IgG1.1f
QVQLVESGGGVVQPGRSLRLSCASSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 191 - protein, 446 aa, Artificial Sequence
  Synthetic:  mAb-CD73.5-Vh-hHC-IgG2-C219S
QVQLVESGGGVVQPGRSLRLSCASSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 192 - protein, 446 aa, Artificial Sequence
  Synthetic:  mAb-CD73.5-Vh-hHC-IgG2-C219S-IgG1.1f
QVQLVESGGGVVQPGRSLRLSCASSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 193 - protein, 450 aa, Artificial Sequence
  Synthetic:  mAb-CD73.6-Vh-hHC-IgG1.1f
QVQLVESGGGVVQPGRSLRLSCAASGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 194 - protein, 446 aa, Artificial Sequence
  Synthetic:  mAb-CD73.6-Vh-hHC-IgG2-C219S
QVQLVESGGGVVQPGRSLRLSCAASGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 195 - protein, 447 aa, Artificial Sequence
  Synthetic:  mAb-CD73.6-Vh-hHC-IgG2-C219S-IgG1.1f
QVQLVESGGGVVQPGRSLRLSCAASGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 450 aa, Artificial Sequence
  Synthetic:  mAb-CD73.7-Vh-hHC-IgG1.1f
QVQLVESGGGVVQPGRSLRLSCASSGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 197 - protein, 446 aa, Artificial Sequence
  Synthetic:  mAb-CD73.7-Vh-hHC-IgG2-C219S
QVQLVESGGGVVQPGRSLRLSCASSGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 198 - protein, 446 aa, Artificial Sequence
  Synthetic:  mAb-CD73.7-Vh-hHC-IgG2-C219S-IgG1.1f
QVQLVESGGGVVQPGRSLRLSCASSGFTFSNYGMHWVRQAPGKGLEWVAVILYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 199 - protein, 450 aa, Artificial Sequence
  Synthetic:  mAb-CD73.8-Vh-hHC-IgG1.1f
QVQLVESGGGVVQPGRSLRLSCAASGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 200 - protein, 446 aa, Artificial Sequence
  Synthetic:  mAb-CD73.8-Vh-hHC-IgG2-C219S
QVQLVESGGGVVQPGRSLRLSCAASGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 201 - protein, 446 aa, Artificial Sequence
  Synthetic:  mAb-CD73.8-Vh-hHC-IgG2-C219S-IgG1.1f
QVQLVESGGGVVQPGRSLRLSCAASGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 202 - protein, 450 aa, Artificial Sequence
  Synthetic:  mAb-CD73.9-Vh-hHC-IgG1.1f
QVQLVESGGGVVQPGRSLRLSCASSGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 203 - protein, 446 aa, Artificial Sequence
  Synthetic:  mAb-CD73.9-Vh-hHC-IgG2-C219S
QVQLVESGGGVVQPGRSLRLSCASSGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 204 - protein, 446 aa, Artificial Sequence
  Synthetic:  mAb-CD73.9-Vh-hHC-IgG2-C219S-IgG1.1f
QVQLVESGGGVVQPGRSLRLSCASSGFTFSNYGMHWVRQAPGKGLEWVAVIWYDSSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205 - protein, 450 aa, Artificial Sequence
  Synthetic:  mAb-CD73.10-Vh-hHC-IgG1.1f
QVQLVESGGGVVQPGRSLRLSCAASGFTFSNYGMHWVRQAPGKGLEWVAVIWYDESNKYYPDSVKGRFTISRDNSKNTLYLQMNSLRAEDTAVYYCARGGSSWYPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 206 - protein, 446 aa, Artificial Sequence
  Synthetic:  mAb-CD73.10-Vh-hHC-IgG2-C219S
QVQLVESGGGVVQPGRSLRLSCAASGFTFSNYGMHWVRQAPGKGLEWVAVIWYDESNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 207 - protein, 446 aa, Artificial Sequence
  Synthetic:  mAb-CD73.10-Vh-hHC-IgG2-C219S-IgG1.1f
QVQLVESGGGVVQPGRSLRLSCAASGFTFSNYGMHWVRQAPGKGLEWVAVIWYDESNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 451 aa, Artificial Sequence
  Synthetic:  mAb-CD73.11-Vh-hHC-IgG1.1f
QVQLVESGGGVVQPGRSLRLSCAASGFTFSNYGMHWVRQAPGKGLEWVAVIWYDESNKYYADSVKGRFTISRDNSKNTLFLQMNSLRAEDTAVYYCARGYNSRWYPDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 209 - protein, 447 aa, Artificial Sequence
  Synthetic:  mAb-CD73.11-Vh-hHC-IgG2-C219S
QVQLVESGGGVVQPGRSLRLSCAASGFTFSNYGMHWVRQAPGKGLEWVAVIWYDESNKYYADSVKGRFTISRDNSKNTLFLQMNSLRAEDTAVYYCARGYNSRWYPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 210 - protein, 447 aa, Artificial Sequence
  Synthetic:  mAb-CD73.11-Vh-hHC-IgG2-C219S-IgG1.1f
QVQLVESGGGVVQPGRSLRLSCAASGFTFSNYGMHWVRQAPGKGLEWVAVIWYDESNKYYADSVKGRFTISRDNSKNTLFLQMNSLRAEDTAVYYCARGYNSRWYPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 211 - DNA, 1347 bp, Artificial Sequence
  Synthetic:  mAb-CD73.3-Vh-hHC-IgG1.1f
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaagagtggtagcataggctatgcggactctgtgaagggccgattcaccatctccagagacaacgccaagaactccctgtatctgcaaatgaacagtctgagagctgaggacacggccttgtattactgtgccaaagggtattacgttattttgactggccttgactactggggccagggaaccctggtcaccgtctcctcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 212 - DNA, 1337 bp, Artificial Sequence
  Synthetic:  mAb-CD73.3-Vh-hHC-IgG2-C219S
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaagagtggtagcataggctatgcggactctgtgaagggccgattcaccatctccagagacaacgccaagaactccctgtatctgcaaatgaacagtctgagagctgaggacacggccttgtattactgtgccaaagggtattacgttattttgactggccttgactactggggccagggaaccctggtcaccgtctcctcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaa

SEQ ID NO: 213 - DNA, 1338 bp, Artificial Sequence
  Synthetic:  mAb-CD73.3-Vh-hHC-IgG2-C219S-IgG1.1f
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaagagtggtagcataggctatgcggactctgtgaagggccgattcaccatctccagagacaacgccaagaactccctgtatctgcaaatgaacagtctgagagctgaggacacggccttgtattactgtgccaaagggtattacgttattttgactggccttgactactggggccagggaaccctggtcaccgtctcctcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 214 - DNA, 1350 bp, Artificial Sequence
  Synthetic:  mAb-CD73.4-Vh-hHC-IgG1.1f
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 215 - DNA, 1341 bp, Artificial Sequence
  Synthetic:  mAb-CD73.4-Vh-hHC-IgG2-C219S
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 216 - DNA, 1341 bp, Artificial Sequence; identical to SEQ ID NO: 134
  Synthetic:  mAb-CD73.4-Vh-hHC-IgG2-C219S-IgG1.1f

SEQ ID NO: 217 - DNA, 1350 bp, Artificial Sequence
  Synthetic:  mAb-CD73.5-Vh-hHC-IgG1.1f
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 218 - DNA, 1341 bp, Artificial Sequence
  Synthetic:  mAb-CD73.5-Vh-hHC-IgG2-C219S
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 219 - DNA, 1341 bp, Artificial Sequence
  Synthetic:  mAb-CD73.5-Vh-hHC-IgG2-C219S-IgG1.1f
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 220 - DNA, 1254 bp, Artificial Sequence
  Synthetic:  mAb-CD73.6-Vh-hHC-IgG1.1f
ggcatgcactgggtccgccaggctccaggcaaggggctggagtgggtggcagttatattgtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 221 - DNA, 1341 bp, Artificial Sequence
  Synthetic:  mAb-CD73.6-Vh-hHC-IgG2-C219S
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatattgtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 222 - DNA, 1341 bp, Artificial Sequence
  Synthetic:  mAb-CD73.6-Vh-hHC-IgG2-C219S-IgG1.1f
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatattgtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 223 - DNA, 1350 bp, Artificial Sequence
  Synthetic:  mAb-CD73.7-Vh-hHC-IgG1.1f
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatattgtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 224 - DNA, 1341 bp, Artificial Sequence
  Synthetic:  mAb-CD73.7-Vh-hHC-IgG2-C219S
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatattgtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 225 - DNA, 1341 bp, Artificial Sequence
  Synthetic:  mAb-CD73.7-Vh-hHC-IgG2-C219S-IgG1.1f
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatattgtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 226 - DNA, 1350 bp, Artificial Sequence
  Synthetic:  mAb-CD73.8-Vh-hHC-IgG1.1f
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatggtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 227 - DNA, 1341 bp, Artificial Sequence
  Synthetic:  mAb-CD73.8-Vh-hHC-IgG2-C219S
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatggtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 228 - DNA, 1341 bp, Artificial Sequence
  Synthetic:  mAb-CD73.8-Vh-hHC-IgG2-C219S-IgG1.1f
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatggtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 229 - DNA, 1350 bp, Artificial Sequence
  Synthetic:  mAb-CD73.9-Vh-hHC-IgG1.1f
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatatggtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 230 - DNA, 1341 bp, Artificial Sequence
  Synthetic:  mAb-CD73.9-Vh-hHC-IgG2-C219S
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatatggtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 231 - DNA, 1341 bp, Artificial Sequence
  Synthetic:  mAb-CD73.9-Vh-hHC-IgG2-C219S-IgG1.1f
caggtgcagctggtggagtctgggggaggcgtggtccagcctgggaggtccctgagactctcctgtgcaagctctggattcaccttcagtaactatggcatgcactgggtccgccaggctccaggcaaggggctggagtgggtggcagttatatggtatgattccagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 232 - DNA, 1350 bp, Artificial Sequence
  Synthetic:  mAb-CD73.10-Vh-hHC-IgG1.1f
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatggtatgatgagagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 233 - DNA, 1341 bp, Artificial Sequence
  Synthetic:  mAb-CD73.10-Vh-hHC-IgG2-C219S
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatggtatgatgagagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 234 - DNA, 1341 bp, Artificial Sequence
  Synthetic:  mAb-CD73.10-Vh-hHC-IgG2-C219S-IgG1.1f
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatggtatgatgagagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 235 - DNA, 1353 bp, Artificial Sequence
  Synthetic:  mAb-CD73.11-Vh-hHC-IgG1.1f
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaagtaataaatactatgcagactccgtgaagggccgattcaccatctccagagacaattccaagaacacgctgtttctgcaaatgaacagcctgagagccgaggacacggctgtgtattattgtgcgagagggtataacagcaggtggtaccctgatgcttttgatatctggggccaagggacaatggtcaccgtctcttcagcgtcgaccaagggcccctccgtgtttcctctggccccttccagcaagtccacctctggcggaacagccgctctgggctgcctggtcaaggactacttccccgagcctgtgaccgtgtcctggaactctggcgccctgacatctggcgtgcacaccttccctgctgtgctgcagtctagcggcctgtactccctgtcctccgtcgtgacagtgccctccagctctctgggcacccagacctacatctgcaacgtgaaccacaagccctccaacaccaaggtggacaagcgggtggaacccaagtcctgcgacaagacccatacctgccctccctgccctgctcctgaagctgaaggcgcccctagcgtgttcctgttccctccaaagcccaaggacaccctgatgatctcccggacccctgaagtgacctgcgtggtggtggatgtgtcccacgaggacccagaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctagctccatcgaaaagaccatctccaaggctaagggccagccccgcgagccccaggtgtacacactgcctccatcccgggaagagatgaccaagaaccaggtgtccctgacttgcctcgtgaagggcttctacccctccgatatcgccgtggaatgggagtccaacggccagcctgagaacaactacaagaccacccctcccgtgctggactccgacggctcattcttcctgtacagcaagctgacagtggataagtcccggtggcagcaggggaacgtgttctcctgctccgtgatgcacgaggctctgcacaaccactacacacagaagtccctgtctctgtcccctggc

SEQ ID NO: 236 - DNA, 1344 bp, Artificial Sequence
  Synthetic:  mAb-CD73.11-Vh-hHC-IgG2-C219S
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaagtaataaatactatgcagactccgtgaagggccgattcaccatctccagagacaattccaagaacacgctgtttctgcaaatgaacagcctgagagccgaggacacggctgtgtattattgtgcgagagggtataacagcaggtggtaccctgatgcttttgatatctggggccaagggacaatggtcaccgtctcttcagcgtcgaccaagggcccctctgtgtttcctctggccccttgctcccggtccacctctgagtctaccgctgctctgggctgcctggtcaaggactacttccccgagcctgtgaccgtgtcctggaactctggcgctctgacctccggcgtgcacacctttccagccgtgctgcagtcctccggcctgtactctctgtcctccgtcgtgaccgtgccctcctccaacttcggcacccagacctacacctgtaacgtggaccacaagccctccaacaccaaggtggacaagaccgtggaacggaagtcctgcgtggaatgccctccttgccctgcacctcctgtggctggcccttccgtgttcctgttccccccaaagcccaaggacaccctgatgatctcccggacccccgaagtgacctgcgtggtggtggatgtgtcccacgaggaccccgaggtgcagttcaattggtacgtggacggcgtggaagtgcacaacgccaagaccaagcccagagaggaacagttcaactccaccttccgggtggtgtccgtgctgaccgtggtgcaccaggactggctgaacggcaaagagtacaagtgcaaggtgtccaacaagggcctgcctgcccccatcgaaaagaccatctccaagacaaagggccagccccgcgagcctcaggtgtacacactgcctcccagccgggaagagatgaccaagaaccaggtgtccctgacctgtctggtcaagggcttctacccctccgatatcgccgtggaatgggagtccaacggccagcccgagaacaactacaagaccaccccccccatgctggactccgacggctcattcttcctgtactccaagctgacagtggacaagtcccggtggcagcagggcaacgtgttctcctgctctgtgatgcacgaggccctgcacaaccactacacccagaagtccctgtccctgagccccggcaaa

SEQ ID NO: 237 - DNA, 363 bp, Artificial Sequence
  Synthetic:  CD73.4 (VH)  Nucleotide sequence
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttca

SEQ ID NO: 238 - protein, 106 aa, Artificial Sequence
  Synthetic:  5F8 VK3
EIVLTQSPATLSLSPGERATLSCRASQSVSSYLAWYQQKPGQAPRLLIYDASNRATGIPARFSGSGSGTDFTLTISSLEPEDFAVYYCQQRSNWWTFGQGTKVEIK

SEQ ID NO: 239 - protein, 11 aa, Artificial Sequence
  Synthetic:  5F8 VK3 CDR1
RASQSVSSYLA

SEQ ID NO: 240 - protein, 7 aa, Artificial Sequence
  Synthetic:  5F8 VK3 CDR2
DASNRAT

SEQ ID NO: 241 - protein, 8 aa, Artificial Sequence
  Synthetic:  5F8 VK3 CDR3
QQRSNWWT

SEQ ID NO: 242 - DNA, 357 bp, Artificial Sequence; identical to SEQ ID NO: 155
  Synthetic:  5F8 VK3  Nucleotide sequence

SEQ ID NO: 243 - DNA, 1341 bp, Artificial Sequence
  Synthetic:  11F11  (full length heavy chain)  NT Seq
caggtgcagctggtggagtctgggggaggcgtggtccagcctgggaggtccctgagactctcctgtgcaacgtctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 244 - DNA, 642 bp, Artificial Sequence
  Synthetic:  11F11  (full length light chain 1)  NT Seq
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcatctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 245 - DNA, 642 bp, Artificial Sequence
  Synthetic:  11F11  (full length light chain 2)  NT Seq
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 246 - DNA, 1350 bp, Artificial Sequence
  Synthetic:  4C3 (full length heavy chain)  NT Seq
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaagagtggtagcataggctatgcggactctgtgaagggccgattcaccatctccagagacaacgccaagaactccctgtatctgcaaatgaacagtctgagagctgaggacacggccttgtattactgtgtaaaagggtattacgttattttgactggccttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 247 - DNA, 642 bp, Artificial Sequence
  Synthetic:  4C3 (full length light chain 1)  NT Seq
gaaattgtgttgacgcagtctccaggcaccctgtctttgtctccaggggaaagagccaccctctcctgcagggccagtcagagtgttagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 248 - DNA, 642 bp, Artificial Sequence
  Synthetic:  4C3 (full length light chain 2)  NT Seq
gacatccagatgacccagtctccatcctcactgtctgcatctgtaggagacagagtcaccttcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccaacgttcggccaggggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 249 - DNA, 642 bp, Artificial Sequence
  Synthetic:  4C3 (full length light chain 3)  NT Seq
gacatccagatgacccagtctccatcctcactgtctgcatctgtaggagacagagtcaccttcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccaacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 250 - DNA, 1344 bp, Artificial Sequence
  Synthetic:  4D4 (full length heavy chain)  NT Seq
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaagtaataaatactatgcagactccgtgaagggccgattcaccatctccagagacaattccaagaacacgctgtttctgcaaatgaacagcctgagagccgaggacacggctgtgtattattgtgcgagagggtataacagcaggtggtaccctgatgcttttgatatctggggccaagggacaatggtcaccgtctcttcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 251 - DNA, 642 bp, Artificial Sequence
  Synthetic:  4D4 (full length light chain 1)  NT Seq
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttacccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 252 - DNA, 1344 bp, Artificial Sequence
  Synthetic:  10D2 (full length heavy chain)  NT Seq
caggtgcagctggtggagtctgggggaggcgtggtccagcctgggaggtccctgagactctcctgtgcagcgtctggattcaccttcagtaactatggcctgcactgggtccgccaggctccaggcaaggggctggagtgggtggcagttatacggtatgatggaagtaataaatactatgcagactccgtgaagggccgattcaccatctccagagacaattccaagaacacgctgtatctgcaaatgagcagcctgagagccgaggacacggctgtgtattactgtgcgagggggggcagcagctggtacccggacggtttggacgtctggggccaagggaccacggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 253 - DNA, 639 bp, Artificial Sequence
  Synthetic:  10D2 (full length light chain 1)  NT Seq
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccccactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 254 - DNA, 642 bp, Artificial Sequence; identical to SEQ ID NO: 251
  Synthetic:  10D2 (full length light chain 2)  NT Seq

SEQ ID NO: 255 - DNA, 1350 bp, Artificial Sequence
  Synthetic:  11A6 (full length heavy chain)  NT Seq
gaagtgcagctggtggaatctgggggaaacttggtacagcctggcaggtccctgagactctcctgtgcagcctctggattcacctttgatgattatgccatgcactgggtccggcaagctccagggaagggcctggagtgggtctcaggtattagttggaataataatgacataggctatgcggactctgtgaagggccgattcatcatctccagagacaacgccaagaactccctgtatctgcaaatgaacagtctgagacctgaggacacggccttgtattattgtgtaaaaggttattacgttattttgactggtcttgactactggggccagggaaccccggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 256 - DNA, 642 bp, Artificial Sequence; identical to SEQ ID NO: 251
  Synthetic:  11A6 (full length light chain 1)  NT Seq

SEQ ID NO: 257 - DNA, 1344 bp, Artificial Sequence
  Synthetic:  24H2 (full length heavy chain)  NT Seq
caggtgcaactggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatggaggtaataaatactatgcagactccgtgaagggccgattcaccatctccagagacaattccaagaacacgctgtttctgcaaatgaacagcctgagagccgaagacacggctgtgtattactgtgcgagagggggcagcagctggtaccctgatgcttttgatatctggggccaagggacaatggtcaccgtctcttcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 258 - DNA, 642 bp, Artificial Sequence; identical to SEQ ID NO: 245
  Synthetic:  24H2 (full length light chain 1)  NT Seq

SEQ ID NO: 259 - DNA, 1347 bp, Artificial Sequence
  Synthetic:  5F8 (full length heavy chain)  NT Seq
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattattagtgatgggagtagcacaggttacgcggattccgtgaagggccgattcaccatctccagagacaacgccaagaacacgctgtatctgcaaatgaacagtctgagagccgaggacacggctgtgtattactgtgcaagagagtttagcagtggctggtactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 260 - DNA, 642 bp, Artificial Sequence
  Synthetic:  5F8 (full length light chain 1)  NT Seq
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttagtagttaccctcggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 261 - DNA, 642 bp, Artificial Sequence
  Synthetic:  5F8 (full length light chain 2)  NT Seq
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacaggtttcactctcaccatcagcagcctgcagcctgaagattttgcaacttattactgccaacagtataatagttaccctcggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 262 - DNA, 1353 bp, Artificial Sequence
  Synthetic:  6E11 (full length heavy chain)  NT Seq
gaagtgcagctggtggagtctgggggagccttggtacagcctggcaggtccctgagactctcctgtgcagcctctggattcacctttgatgattatgccatgcactgggtccggcaagctccagggaagggcctggagtgggtctcaggtattacttggaatagtggtggcataggctacgcggactctgtgaagggccgattcaccatctccagagacaacgccaagaactccctgtatctgcaaatgaacagtctgagagctgaggacacggccttgtattactgtgcaaaagataggtattacagcagttggctcctctttgacaactggggccagggaattctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 263 - DNA, 642 bp, Artificial Sequence
  Synthetic:  6E11 (full length light chain 1)  NT Seq
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcattatggtagctcattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 264 - DNA, 1353 bp, Artificial Sequence
  Synthetic:  7A11 (full length heavy chain)  NT Seq
gaagtgcagctggtggagtctgggggaggcttggtacagactggcaggtccctgagactctcctgtgcagcctctggattcacctttgatgattatgccatgcactgggtccggcaagctccagggaagggcctggagtgggtctcagatattagttggaatagtgatattataggctatgcggactctgtgaagggccgattcaccatctctagagacaacgccaagaactccctgtatctgcaaatgaacagtctgagagctgaggacacggccttgtattactgtgcaaaagatatttatggttcggggagttctttttttgactactggggccagggaatcctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 265 - DNA, 642 bp, Artificial Sequence
  Synthetic:  7A11 (full length light chain 1)  NT Seq
gacatccagatgacccagtctccatcctcactgtctgcatctgtaggagacagagtcaccatcacttgtcgggcgagtcagtatattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtatcatagttaccctcccaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 266 - DNA, 1341 bp, Artificial Sequence
  Synthetic:  CD73.4.IgG2C219SIgG1.1f  Alternative NT Seq
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatattgtatgatggaagtaataaatactatccagactccgtgaagggccgattcaccatctccagagacaattccaagaacacgctgtatctgcaaatgaacagcctgagagccgaggacacggctgtgtattactgtgcgagagggggcagcagctggtaccctgattcttttgatatctggggccaaggaacaatggtcaccgtctcttcagcgtcgaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatcctgtgtcgagtgcccaccgtgcccagcaccacctgtggcaggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 267 - protein, 330 aa, Artificial Sequence
  Synthetic:  IgG1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - protein, 326 aa, Artificial Sequence
  Synthetic:  IgG2.3
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 269 - protein, 327 aa, Artificial Sequence
  Synthetic:  IgG2.3G1-AY
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 326 aa, Artificial Sequence; identical to SEQ ID NO: 165
  Synthetic:  IgG2.3G1-KH

SEQ ID NO: 271 - protein, 326 aa, Artificial Sequence
  Synthetic:  IgG2.5
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 272 - protein, 330 aa, Artificial Sequence
  Synthetic:  IgG1.1f
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 273 - protein, 326 aa, Artificial Sequence; identical to SEQ ID NO: 169
  Synthetic:  IgG2.3G1.1f-KH

SEQ ID NO: 274 - protein, 327 aa, Artificial Sequence
  Synthetic:  IgG1-deltaTHT
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 329 aa, Artificial Sequence
  Synthetic:  IgG2.3-plusTHT
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVETHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 276 - protein, 329 aa, Artificial Sequence
  Synthetic:  IgG2.3-plusGGG
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVEGGGCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 277 - protein, 326 aa, Artificial Sequence
  Synthetic:  IgG2.5G1.1f-KH
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - protein, 327 aa, Artificial Sequence
  Synthetic:  IgG2.5G1-AY
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 279 - protein, 326 aa, Artificial Sequence
  Synthetic:  IgG2.5G1-KH
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 280 - protein, 329 aa, Artificial Sequence
  Synthetic:  IgG2.5-plusTHT
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVETHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 281 - protein, 327 aa, Artificial Sequence
  Synthetic:  IgG1-G2.3G1-AY
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - protein, 326 aa, Artificial Sequence
  Synthetic:  IgG1-G2.3G1-KH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 553 aa, Artificial Sequence
  Synthetic:  CD73 from Figure 27A
  misc_feature (1)..(1): Xaa can be any naturally occurring amino acid
XCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHADETFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKHHHHHH

SEQ ID NO: 284 - protein, 5 aa, Homo sapiens
  misc_feature (1)..(5): Hinge region amino acid
VDKRV

SEQ ID NO: 285 - protein, 5 aa, Homo sapiens
  misc_feature (1)..(5): Hinge region amino acid
VDKTV

SEQ ID NO: 286 - protein, 10 aa, Homo sapiens
  misc_feature (1)..(10): Hinge region amino acid
EPKSCDKTHT

SEQ ID NO: 287 - protein, 12 aa, Homo sapiens
  misc_feature (1)..(12): Hinge region amino acid
ELKTPLGDTTHT

SEQ ID NO: 288 - protein, 4 aa, Homo sapiens
  misc_feature (1)..(4): Hinge region amino acid
EPKS

SEQ ID NO: 289 - protein, 7 aa, Homo sapiens
  misc_feature (1)..(7): Hinge region amino acid
ESKYGPP

SEQ ID NO: 290 - protein, 5 aa, Homo sapiens
  misc_feature (1)..(5): Hinge region amino acid
CPPCP

SEQ ID NO: 291 - protein, 9 aa, Homo sapiens
  misc_feature (1)..(9): Hinge region amino acid
CCVECPPCP

SEQ ID NO: 292 - protein, 50 aa, Homo sapiens
  misc_feature (1)..(50): Hinge region amino acid
CPRCPEPKSCDTPPPCPRCPEPKSCDTPPPCPRCPEPKSCDTPPPCPRCP

SEQ ID NO: 293 - protein, 35 aa, Homo sapiens
  misc_feature (1)..(35): Hinge region amino acid
CPRCPEPKSCDTPPPCPRCPEPKSCDTPPPCPRCP

SEQ ID NO: 294 - protein, 20 aa, Homo sapiens
  misc_feature (1)..(20): Hinge region amino acid
CPRCPEPKSCDTPPPCPRCP

SEQ ID NO: 295 - protein, 41 aa, Homo sapiens
  misc_feature (1)..(41): Hinge region amino acid
CDTPPPCPRCPEPKSCDTPPPCPRCPEPKSCDTPPPCPRCP

SEQ ID NO: 296 - protein, 11 aa, Homo sapiens
  misc_feature (1)..(11): Hinge region amino acid
CDTPPPCPRCP

SEQ ID NO: 297 - protein, 5 aa, Homo sapiens
  misc_feature (1)..(5): Hinge region amino acid
CPSCP

SEQ ID NO: 298 - protein, 7 aa, Homo sapiens
  misc_feature (1)..(7): Hinge region amino acid
APELLGG

SEQ ID NO: 299 - protein, 6 aa, Homo sapiens
  misc_feature (1)..(6): Hinge region amino acid
APPVAG

SEQ ID NO: 300 - protein, 330 aa, Artificial Sequence
  Synthetic: G2-G1-G1-G1
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 330 aa, Artificial Sequence
  Synthetic: G2.5-G1-G1-G1
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - protein, 326 aa, Artificial Sequence
  Synthetic: G1-G2.3-G2-G2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 303 - protein, 330 aa, Artificial Sequence
  Synthetic: G1-KRGEGSSNLF
ASTKGPSVFPLAPSSRSTSESTAALGCLVKDYFPEPVTVSWNSGALTSGVHTFPAVLQSSGLYSLSSVVTVPSSNFGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 304 - protein, 330 aa, Artificial Sequence
  Synthetic: G1-KRGEGS
ASTKGPSVFPLAPSSRSTSESTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 330 aa, Artificial Sequence
  Synthetic: G1-SNLF
ASTKGPSVFPLAPSSKSTSGGTAALGCLVKDYFPEPVTVSWNSGALTSGVHTFPAVLQSSGLYSLSSVVTVPSSNFGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 330 aa, Artificial Sequence
  Synthetic: IgG1-ITNDRTPR
ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKTVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 329 aa, Artificial Sequence
  Synthetic: G1-SNLFPR
ASTKGPSVFPLAPSSKSTSGGTAALGCLVKDYFPEPVTVSWNSGALTSGVHTFPAVLQSSGLYSLSSVVTVPSSNFGTQTYICNVNHKPSNTKVDKRVERKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 308 - protein, 326 aa, Artificial Sequence
  Synthetic: G2-RKEGSGNSFL
ASTKGPSVFPLAPCSKSTSGGTAALGCLVKDYFPEPVTVSWNSGALTSGVHTFPAVLQSSGLYSLSSVVTVPSSSLGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 309 - protein, 326 aa, Artificial Sequence
  Synthetic: G2-RKEGSG
ASTKGPSVFPLAPCSKSTSGGTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 310 - protein, 326 aa, Artificial Sequence
  Synthetic: G2-NSFL
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVERKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 311 - protein, 326 aa, Artificial Sequence
  Synthetic: IgG2-TIDNTRRP
ASTKGPSVFPLAPCSRSTSESTAALGCLVKDYFPEPVTVSWNSGALTSGVHTFPAVLQSSGLYSLSSVVTVPSSNFGTQTYICNVNHKPSNTKVDKRVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 312 - protein, 326 aa, Artificial Sequence
  Synthetic: G2-NSFLRP
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVEPKSCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 313 - protein, 330 aa, Artificial Sequence
  Synthetic: G1-G1-G2-G1-AY
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - protein, 329 aa, Artificial Sequence
  Synthetic: G1-G1-G2-G1-KH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 326 aa, Artificial Sequence
  Synthetic: G2-G2.3-G1-G2-KH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 316 - protein, 326 aa, Artificial Sequence
  Synthetic: G2.5-G2.3-G1-G2-KH
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 317 - protein, 326 aa, Artificial Sequence
  Synthetic: G2-G2.3-G1-G2-AY
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 318 - protein, 327 aa, Artificial Sequence
  Synthetic: G2.5-G2.3-G1-G2-AY
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 319 - protein, 326 aa, Artificial Sequence
  Synthetic: G1-G2.3-G1-G1-KH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCVECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 320 - protein, 330 aa, Artificial Sequence
  Synthetic: G2-G1-G2-G2-AY
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 321 - protein, 330 aa, Artificial Sequence
  Synthetic: G2.5-G1-G2-G2-AY
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 322 - protein, 327 aa, Artificial Sequence
  Synthetic: G1-G2-G1-G1-AY
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 323 - protein, 328 aa, Artificial Sequence
  Synthetic: G2-G1-G2-G2-KH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 324 - protein, 329 aa, Artificial Sequence
  Synthetic: G2.5-G1-G2-G2-KH
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 325 - protein, 323 aa, Artificial Sequence
  Synthetic: IgG1-deltaHinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - protein, 322 aa, Artificial Sequence
  Synthetic: IgG2-deltaHinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 327 - protein, 322 aa, Artificial Sequence
  Synthetic: IgG2.5-deltaHinge
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 328 - protein, 328 aa, Artificial Sequence
  Synthetic: IgG1-deltaG237
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 329 - protein, 327 aa, Artificial Sequence
  Synthetic: IgG2-plusG237
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 330 - protein, 326 aa, Artificial Sequence
  Synthetic: IgG2.4
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 331 - protein, 326 aa, Artificial Sequence
  Synthetic: IgG2.3/4
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 332 - protein, 326 aa, Artificial Sequence
  Synthetic: IgG2.3-V13
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 333 - protein, 326 aa, Artificial Sequence
  Synthetic: IgG2.3-V14
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSHEDGEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 334 - protein, 326 aa, Artificial Sequence
  Synthetic: IgG2.3-V15
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSDEDGEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 335 - protein, 326 aa, Artificial Sequence
  Synthetic: IgG2.3-V16
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSHEDGEVQFNWYVDGVEVHNAKTKPREEQFNSTFRVVSVLTVVHQDWLNGKEYKCKVSNKGLPRPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 336 - protein, 326 aa, Artificial Sequence
  Synthetic: IgG2.3-V17
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGDSVFLFPPKPKDTLMISRTPEVTCVVVDVSDEDGEVQFNWYVDGVEVHNAKTKPREEQFNSTFRVVSVLTVVHQDWLNGKEYKCKVSNKGLPRPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 337 - protein, 326 aa, Artificial Sequence
  Synthetic: IgG2.3-V18
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVEHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 338 - protein, 326 aa, Artificial Sequence
  Synthetic: IgG2.3-V19
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVEHEDPEVQFNWYVDGVEVHNAKTKPREEQFNSTFRVVSVLTVVHQDWLNGKEYKCKVSNKGFPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 339 - protein, 327 aa, Artificial Sequence
  Synthetic: IgG2.3G1-AY-V20
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - protein, 327 aa, Artificial Sequence
  Synthetic: IgG2.3G1-AY-V21
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSHEDGEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 327 aa, Artificial Sequence
  Synthetic: IgG2.3G1-AY-V22
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSDEDGEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 342 - protein, 327 aa, Artificial Sequence
  Synthetic: IgG2.3G1-AY-V23
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSHEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 343 - protein, 327 aa, Artificial Sequence
  Synthetic: IgG2.3G1-AY-V24
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 344 - protein, 327 aa, Artificial Sequence
  Synthetic: IgG2.3G1-AY-V25
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - protein, 327 aa, Artificial Sequence
  Synthetic: IgG2.3G1-AY-V26
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPDLLGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - protein, 327 aa, Artificial Sequence
  Synthetic: IgG2.3G1-AY-V27
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVEHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - protein, 327 aa, Artificial Sequence
  Synthetic: IgG2.3G1-AY-V28
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKSCVECPPCPAPELLGGPSVFLFPPKPKDTLMISRTPEVTCVVVDVEHEDPEVKFNWYVDGVEVHNAKTKPREEQYNSTYRVVSVLTVLHQDWLNGKEYKCKVSNKAFPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 348 - protein, 18 aa, Artificial Sequence
  Synthetic: Alternative hinge
ERKCCVECPPCPAPPVAG

SEQ ID NO: 349 - protein, 18 aa, Artificial Sequence
  Synthetic: Alternative hinge
ERKSCVECPPCPAPPVAG

SEQ ID NO: 350 - protein, 18 aa, Artificial Sequence
  Synthetic: Alternative hinge
ERKCSVECPPCPAPPVAG

SEQ ID NO: 351 - protein, 18 aa, Artificial Sequence
  Synthetic: Alternative hinge
  misc_feature (4)..(4): Xaa can be any naturally occurring amino acid
ERKXCVECPPCPAPPVAG

SEQ ID NO: 352 - protein, 18 aa, Artificial Sequence
  Synthetic: Alternative hinge
  misc_feature (5)..(5): Xaa can be any naturally occurring amino acid
ERKCXVECPPCPAPPVAG

SEQ ID NO: 353 - protein, 19 aa, Artificial Sequence
  Synthetic: Alternative hinge
  misc_feature (19)..(19): Xaa can be any naturally occurring amino acid
ERKCCVECPPCPAPPVAGX

SEQ ID NO: 354 - protein, 19 aa, Artificial Sequence
  Synthetic: Alternative hinge
  misc_feature (19)..(19): Xaa can be any naturally occurring amino acid
ERKSCVECPPCPAPPVAGX

SEQ ID NO: 355 - protein, 19 aa, Artificial Sequence
  Synthetic: Alternative hinge
  misc_feature (19)..(19): Xaa can be any naturally occurring amino acid
ERKCSVECPPCPAPPVAGX

SEQ ID NO: 356 - protein, 19 aa, Artificial Sequence
  Synthetic: Alternative hinge
  misc_feature (4)..(4): Xaa can be any naturally occurring amino acid
  misc_feature (19)..(19): Xaa can be any naturally occurring amino acid
ERKXCVECPPCPAPPVAGX

SEQ ID NO: 357 - protein, 19 aa, Artificial Sequence
  Synthetic: Alternative hinge
  misc_feature (5)..(5): Xaa can be any naturally occurring amino acid
  misc_feature (19)..(19): Xaa can be any naturally occurring amino acid
ERKCXVECPPCPAPPVAGX

SEQ ID NO: 358 - protein, 19 aa, Artificial Sequence
  Synthetic: Alternative hinge
ERKCCVECPPCPAPELLGG

SEQ ID NO: 359 - protein, 19 aa, Artificial Sequence
  Synthetic: Alternative hinge
ERKSCVECPPCPAPELLGG

SEQ ID NO: 360 - protein, 20 aa, Artificial Sequence
  Synthetic: Alternative hinge
ERKCCSVECPPCPAPELLGG

SEQ ID NO: 361 - protein, 19 aa, Artificial Sequence
  Synthetic: Alternative hinge
  misc_feature (4)..(4): Xaa can be any naturally occurring amino acid
ERKXCVECPPCPAPELLGG

SEQ ID NO: 362 - protein, 19 aa, Artificial Sequence
  Synthetic: Alternative hinge
  misc_feature (5)..(5): Xaa can be any naturally occurring amino acid
ERKCXVECPPCPAPELLGG

SEQ ID NO: 363 - protein, 18 aa, Artificial Sequence
  Synthetic: Alternative hinge
ERKCCVECPPCPAPELLG

SEQ ID NO: 364 - protein, 18 aa, Artificial Sequence
  Synthetic: Alternative hinge
ERKSCVECPPCPAPELLG

SEQ ID NO: 365 - protein, 19 aa, Artificial Sequence
  Synthetic: Alternative hinge
ERKCCSVECPPCPAPELLG

SEQ ID NO: 366 - protein, 18 aa, Artificial Sequence
  Synthetic: Alternative hinge
  misc_feature (4)..(4): Xaa can be any naturally occurring amino acid
ERKXCVECPPCPAPELLG

SEQ ID NO: 367 - protein, 18 aa, Artificial Sequence
  Synthetic: Alternative hinge
  misc_feature (5)..(5): Xaa can be any naturally occurring amino acid
ERKCXVECPPCPAPELLG

SEQ ID NO: 368 - protein, 14 aa, Artificial Sequence
  Synthetic: Alternative hinge
ERKCCVECPPCPAP

SEQ ID NO: 369 - protein, 14 aa, Artificial Sequence
  Synthetic: Alternative hinge
ERKSCVECPPCPAP

SEQ ID NO: 370 - protein, 14 aa, Artificial Sequence
  Synthetic: Alternative hinge
ERKCSVECPPCPAP

SEQ ID NO: 371 - protein, 14 aa, Artificial Sequence
  Synthetic: Alternative hinge
  misc_feature (4)..(4): Xaa can be any naturally occurring amino acid
ERKXCVECPPCPAP

SEQ ID NO: 372 - protein, 14 aa, Artificial Sequence
  Synthetic: Alternative hinge
  misc_feature (5)..(5): Xaa can be any naturally occurring amino acid
ERKCXVECPPCPAP

SEQ ID NO: 373 - protein, 4 aa, Artificial Sequence
  Synthetic: Portion of hinge
PVAG

SEQ ID NO: 374 - protein, 4 aa, Artificial Sequence
  Synthetic: Portion of hinge
ELLG

SEQ ID NO: 375 - protein, 5 aa, Artificial Sequence
  Synthetic: Portion of hinge
ELLGG

SEQ ID NO: 376 - protein, 7 aa, Artificial Sequence
  Synthetic: Portion of hinge
SCDKTHT

SEQ ID NO: 377 - protein, 4 aa, Artificial Sequence
  Synthetic: Portion of hinge
CCVE

SEQ ID NO: 378 - protein, 98 aa, Artificial Sequence; identical to SEQ ID NO: 124
  Synthetic: wt IgG2 CH1 domain

SEQ ID NO: 379 - protein, 116 aa, Artificial Sequence
  Synthetic: IgG2 CH1 and hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAG

SEQ ID NO: 380 - protein, 7 aa, Artificial Sequence
  Synthetic: Portion of hinge
CPPCPAP

We claim:

1. An isolated antibody that binds to human CD73 and comprises a heavy chain comprising CDR1, CDR2, and CDR3sequences comprising the amino acid sequences of SEQ ID NOs: 5, 6, and 7, respectively, and a light chain comprising CDR1, CDR2, and CDR3 sequences comprising the amino acid sequences of SEQ ID NOs: 13, 14, and 15, respectively.

2. The isolated antibody of claim 1, comprising heavy and light chain variable regions, wherein the heavy and light chain variable regions comprise the amino acid sequences of SEQ ID NOs: 135 and 12, respectively.

3. An isolated antibody that binds to human CD73 and comprises a heavy chain sequence comprising the amino acid sequence of SEQ ID NO: 133 or 189and a light chain sequence comprising the amino acid sequence of SEQ ID NO: 102.

4. The isolated antibody of claim 1, which binds to human CD73 with a $K_D$ of 0.1 nM to 10 nM, as determined by Surface Plasmon Resonance (SPR).

5. The isolated antibody of claim 1, wherein the antibody inhibits the activity of human CD73.

6. The isolated antibody of claim 1, wherein the antibody mediates internalization of human CD73.

7. The isolated antibody of claim 1, wherein the antibody has reduced effector function relative to a wild type IgG1 antibody.

8. The isolated antibody of claim 2, which binds to human CD73 with a $K_D$ of 0.1 nM to 10 nM, as determined by Surface Plasmon Resonance (SPR).

9. The isolated antibody of claim 2, wherein the antibody inhibits the activity of human CD73.

10. The isolated antibody of claim 2, wherein the antibody mediates internalization of human CD73.

11. The isolated antibody of claim 2, wherein the antibody has reduced effector function relative to a wild type IgG1 antibody.

12. A composition comprising the antibody of claim 1, and a pharmaceutically acceptable carrier.

13. A composition comprising the antibody of claim 2, and a pharmaceutically acceptable carrier.

14. The composition of claim 13, further comprising one or more additional therapeutic agents.

15. The composition of claim 14, wherein the additional therapeutic agent is a programmed cell death protein 1 (PD-1) antagonist, a programmed death-ligand 1 (PD-L1) antagonist, a cytotoxic T-lymphocyte-associated protein 4 (CTLA-4) antagonist, or a lymphocyte activation gene-3 (LAG-3) antagonist.

16. A composition comprising the antibody of claim 3, and a pharmaceutically acceptable carrier.

17. The composition of claim 16, further comprising one or more additional therapeutic agents.

18. The composition of claim 17, wherein the additional therapeutic agent is a PD-1 antagonist, a PD-L1 antagonist, a CTLA-4 antagonist, or a LAG-3antagonist.

19. An isolated antibody that binds to human CD73 and comprises a heavy chain comprising CDR1, CDR2, and CDR3 sequences comprising the amino acid sequences of SEQ ID NOs: 5, 6, and 7, respectively, and a light chain comprising CDR1, CDR2, and CDR3 sequences comprising the amino acid sequences of SEQ ID NOs: 13, 14, and 15, respectively, wherein the heavy chain is a full-length heavy chain and the light chain is a full-length light chain.

20. An isolated antibody that binds to human CD73 and comprises heavy and light chain variable regions, wherein the heavy and light chain variable regions comprise the amino acid sequences of SEQ ID NOs: 135 and 12, respectively, wherein the heavy chain is a full-length heavy chain and the light chain is a full-length light chain.

21. The isolated antibody of claim 19, which is an IgG antibody.

22. The isolated antibody of claim 20, which is an IgG antibody.

23. An isolated antibody which binds to human CD73 and comprises a heavy chain consisting of the amino acid sequence of SEQ ID NO: 133 and a light chain consisting of the amino acid sequence of SEQ ID NO: 102.

24. An isolated antibody which binds to human CD73 and comprises a heavy chain consisting of the amino acid sequence of SEQ ID NO: 189 and a light chain consisting of the amino acid sequence of SEQ ID NO: 102.

25. A composition comprising the antibody of claim 23, and a pharmaceutically acceptable carrier.

26. The composition of claim 25, further comprising one or more additional therapeutic agents.

27. The composition of claim 26, wherein the additional therapeutic agent is a PD-1 antagonist, a PD-L1 antagonist, a CTLA-4 antagonist, or a LAG-3antagonist.

28. A composition comprising the antibody of claim 24, and a pharmaceutically acceptable carrier.

29. The composition of claim 28, further comprising one or more additional therapeutic agents.

30. The composition of claim 29, wherein the additional therapeutic agent is a PD-1 antagonist, a PD-L1 antagonist, a CTLA-4 antagonist, or a LAG-3antagonist.

* * * * *

UNITED STATES PATENT AND TRADEMARK OFFICE
CERTIFICATE OF CORRECTION

| | | |
|---|---|---|
| PATENT NO. | : 9,605,080 B2 | Page 1 of 1 |
| APPLICATION NO. | : 14/994828 | |
| DATED | : March 28, 2017 | |
| INVENTOR(S) | : Nils Lonberg et al. | |

It is certified that error appears in the above-identified patent and that said Letters Patent is hereby corrected as shown below:

In the Claims

At Column 249, Claim number 1, Line number 27, delete:
"CDR3sequences"
And insert:
-- CDR3 sequences --

At Column 249, Claim number 3, Line number 38, delete:
"189and"
And insert:
-- 189 and --

At Column 250, Claim number 18, Line number 28, delete:
"LAG-3antagonist"
And insert:
-- LAG-3 antagonist --

At Column 250, Claim number 27, Line number 59, delete:
"LAG-3antagonist"
And insert:
-- LAG-3 antagonist --

At Column 250, Claim number 30, Line number 66, delete:
"LAG-3antagonist"
And insert:
-- LAG-3 antagonist --

Signed and Sealed this
Twenty-eighth Day of November, 2017

Joseph Matal
*Performing the Functions and Duties of the*
*Under Secretary of Commerce for Intellectual Property and*
*Director of the United States Patent and Trademark Office*